United States Patent 8,575,070 (METHODS OF CONSTRUCTING AND SCREENING LIBRARIES OF PEPTIDE STRUCTURES) - sequence listing, part 2

SEQ ID NO: 26953 - protein, 25 aa, artificial
  peptide fold or domain or sub-domain
NTITKIQLNMNQININEVILNYQYF

SEQ ID NO: 26954 - protein, 26 aa, artificial
  peptide fold or domain or sub-domain
HTFFVYFALIYNCICFKNLTYFSFSN

SEQ ID NO: 26955 - protein, 24 aa, artificial
  peptide fold or domain or sub-domain
MKRKTFFVQNIYQECYINFNKIFF

SEQ ID NO: 26956 - protein, 27 aa, artificial
  peptide fold or domain or sub-domain
ICLSLFLDLSNNISFQNCHELKKKIKL

SEQ ID NO: 26957 - protein, 21 aa, artificial
  peptide fold or domain or sub-domain
MLLNPYSDEIQKPNMQQKMGT

SEQ ID NO: 26958 - protein, 29 aa, artificial
  peptide fold or domain or sub-domain
MHTCGLVGKYQYEGGCFAHVNICGLTING

SEQ ID NO: 26959 - protein, 14 aa, artificial
  peptide fold or domain or sub-domain
MLCIFCYVSELGNI

SEQ ID NO: 26960 - protein, 24 aa, artificial
  peptide fold or domain or sub-domain
YPHLGCIFELHFEIKHMRVVYIFN

SEQ ID NO: 26961 - protein, 28 aa, artificial
  peptide fold or domain or sub-domain
MVRFRVAFWETRILCQVIVLFYVISVLG

SEQ ID NO: 26962 - protein, 23 aa, artificial
  peptide fold or domain or sub-domain
MHLLDKNCYEDNNCLSKALILAV

SEQ ID NO: 26963 - protein, 26 aa, artificial
  peptide fold or domain or sub-domain
EKCYGAFFILMATLLWEYIFLNSSRD

SEQ ID NO: 26964 - protein, 23 aa, artificial
  peptide fold or domain or sub-domain
MLKQMHQILIKNIHFFLYIRCGT

SEQ ID NO: 26965 - protein, 26 aa, artificial
  peptide fold or domain or sub-domain
MFENMLSHLRKIDAIQLHEKKGAKNK

SEQ ID NO: 26966 - protein, 22 aa, artificial
  peptide fold or domain or sub-domain
EIKYAYNVDPSYFKKIYNRNIY

SEQ ID NO: 26967 - protein, 19 aa, artificial
  peptide fold or domain or sub-domain
HTTIEAINKCANGLYLKQR

SEQ ID NO: 26968 - protein, 26 aa, artificial
  peptide fold or domain or sub-domain
QYMYVCSFICRSRYARKQSSLTCMLE

SEQ ID NO: 26969 - protein, 11 aa, artificial
  peptide fold or domain or sub-domain
MYIRVHSGSKK

SEQ ID NO: 26970 - protein, 27 aa, artificial
  peptide fold or domain or sub-domain
MFKNYYYSFLFLFHHLFYISHLFYIYL

SEQ ID NO: 26971 - protein, 23 aa, artificial
  peptide fold or domain or sub-domain
HIALFEWYEKCKINNGQIIILYF

SEQ ID NO: 26972 - protein, 27 aa, artificial
  peptide fold or domain or sub-domain
MYIFLHPFPISTTMDTGVCMHMNIYIL

SEQ ID NO: 26973 - protein, 24 aa, artificial
  peptide fold or domain or sub-domain
FLYFIGENYLLNINYICATFRIFN

SEQ ID NO: 26974 - protein, 28 aa, artificial
  peptide fold or domain or sub-domain
MVLIESISKQDVKFTEKGLKLTIQKKSQ

SEQ ID NO: 26975 - protein, 26 aa, artificial
  peptide fold or domain or sub-domain
KVYILTSQLYKCICVIANIFMVFLLN

SEQ ID NO: 26976 - protein, 29 aa, artificial
  peptide fold or domain or sub-domain
KLNLITGNILIFDYNFFHLHIKILKTGTN

SEQ ID NO: 26977 - protein, 30 aa, artificial
  peptide fold or domain or sub-domain
YITSFYIHNNLIKTLLVQINYYIHFLYILH

SEQ ID NO: 26978 - protein, 24 aa, artificial
  peptide fold or domain or sub-domain
MKHIIVQRVYYILIHFKNKVEMFI

SEQ ID NO: 26979 - protein, 29 aa, artificial
  peptide fold or domain or sub-domain
LYGPFNINLCPFFVSYLAFEFHLIIKHTE

SEQ ID NO: 26980 - protein, 21 aa, artificial
  peptide fold or domain or sub-domain
MVTTAMDTSQISDDKIIIIFL

SEQ ID NO: 26981 - protein, 21 aa, artificial
  peptide fold or domain or sub-domain
LFLFNNYIILFYKCRQCYIKY

SEQ ID NO: 26982 - protein, 28 aa, artificial
  peptide fold or domain or sub-domain
MYMMIMIPIKPLFKTKESNKEIFTNLMK

SEQ ID NO: 26983 - protein, 19 aa, artificial
  peptide fold or domain or sub-domain
KIRLKPLSCFNDRIYSYQG

SEQ ID NO: 26984 - protein, 21 aa, artificial
  peptide fold or domain or sub-domain
QLNYVSLLYKSKKGNFYGIKY

SEQ ID NO: 26985 - protein, 25 aa, artificial
  peptide fold or domain or sub-domain
CSLKMLIEKCVLENHKPSLECFLQM

SEQ ID NO: 26986 - protein, 22 aa, artificial
  peptide fold or domain or sub-domain
LLMENIIFTHMGGMPHYSQQIL

SEQ ID NO: 26987 - protein, 29 aa, artificial
  peptide fold or domain or sub-domain
MTTYFTRKLAQLGMNKAGINVCINLINAI

SEQ ID NO: 26988 - protein, 30 aa, artificial
  peptide fold or domain or sub-domain
MVFSSDKFENSGNDQFKYRSFSMNIVISEA

SEQ ID NO: 26989 - protein, 27 aa, artificial
  peptide fold or domain or sub-domain
MGTYFCTVTHVENVENDENEIILDYVR

SEQ ID NO: 26990 - protein, 28 aa, artificial
  peptide fold or domain or sub-domain
PYSGLIREIIHIDKYILTLCKYGILKKE

SEQ ID NO: 26991 - protein, 29 aa, artificial
  peptide fold or domain or sub-domain
MNILNDKFHPFSASWLRSICSTCSYQRDS

SEQ ID NO: 26992 - protein, 25 aa, artificial
  peptide fold or domain or sub-domain
MSKAGFEPALPHPQCGVLTTRRFGR

SEQ ID NO: 26993 - protein, 27 aa, artificial
  peptide fold or domain or sub-domain
MLVHPSFYIFVHPSFYIFVHPSFYIFV

SEQ ID NO: 26994 - protein, 26 aa, artificial
  peptide fold or domain or sub-domain
FFSSRNIWTQNNRPRVFLMPPHKQRD

SEQ ID NO: 26995 - protein, 29 aa, artificial
  peptide fold or domain or sub-domain
MMKLLDMKIPNAQNEEEITMDSTIKNSSI

SEQ ID NO: 26996 - protein, 30 aa, artificial
  peptide fold or domain or sub-domain
FVFPFNIIMKSGATWLPINTKHMHISNTLK

SEQ ID NO: 26997 - protein, 30 aa, artificial
  peptide fold or domain or sub-domain
MTNSGHLWNFSYICINMHKIERTCDLTCVL

SEQ ID NO: 26998 - protein, 28 aa, artificial
  peptide fold or domain or sub-domain
KTHIYVPLHENWYCLCFHKYGLIMQSIL

SEQ ID NO: 26999 - protein, 23 aa, artificial
  peptide fold or domain or sub-domain
MGNMVCGLFHIILFPFWLHILTF

SEQ ID NO: 27000 - protein, 28 aa, artificial
  peptide fold or domain or sub-domain
MSIALSHFPILYICYDIVIFQYDSIFMK

SEQ ID NO: 27001 - protein, 25 aa, artificial
  peptide fold or domain or sub-domain
ILSRGLHKKCFKIYNRGICVFFRCI

SEQ ID NO: 27002 - protein, 22 aa, artificial
  peptide fold or domain or sub-domain
YTRFTNYYDDNSFYVMCIMRKM

SEQ ID NO: 27003 - protein, 14 aa, artificial
  peptide fold or domain or sub-domain
FNTFESWVAQYLEE

SEQ ID NO: 27004 - protein, 20 aa, artificial
  peptide fold or domain or sub-domain
FSLLMTLTNFICIIFWNYKI

SEQ ID NO: 27005 - protein, 17 aa, artificial
  peptide fold or domain or sub-domain
YFIFLIANNFICINFCN

SEQ ID NO: 27006 - protein, 18 aa, artificial
  peptide fold or domain or sub-domain
YFIFLIYSNFICINFCNY

SEQ ID NO: 27007 - protein, 27 aa, artificial
  peptide fold or domain or sub-domain
FSFMLINLIIKFGLVYEWNLGMIDWLK

SEQ ID NO: 27008 - protein, 30 aa, artificial
  peptide fold or domain or sub-domain
IKLLNVLTSLDSISEYSGRRVALVFSVNGA

SEQ ID NO: 27009 - protein, 13 aa, artificial
  peptide fold or domain or sub-domain
HSGHKQTDTDHLI

SEQ ID NO: 27010 - protein, 22 aa, artificial
  peptide fold or domain or sub-domain
MQSRTIIPNSNGRTRWMRFCMK

SEQ ID NO: 27011 - protein, 30 aa, artificial
  peptide fold or domain or sub-domain
MRLRGGPSAWVSGIWVGVDMCMLKYNKLNH

SEQ ID NO: 27012 - protein, 28 aa, artificial
  peptide fold or domain or sub-domain
MNDTIFKIDGSEANISIEISGITRYDTS

SEQ ID NO: 27013 - protein, 27 aa, artificial
  peptide fold or domain or sub-domain
MYNQIRPLQQLEILIKNVKTLIICSLS

SEQ ID NO: 27014 - protein, 29 aa, artificial
  peptide fold or domain or sub-domain
MRKMPRFLSIHSGFLHILLSFYSLLFLAA

SEQ ID NO: 27015 - protein, 25 aa, artificial
  peptide fold or domain or sub-domain
LEQKSSLYKLAIEAQYLIPIINRET

SEQ ID NO: 27016 - protein, 28 aa, artificial
  peptide fold or domain or sub-domain
MSNRWRFVVVVTLFTYCLTFERVSMEQL

SEQ ID NO: 27017 - protein, 23 aa, artificial
  peptide fold or domain or sub-domain
MEEKRGELNKTDQATIVPQKKCE

SEQ ID NO: 27018 - protein, 30 aa, artificial
  peptide fold or domain or sub-domain
MPIGKTFDCITNGEEIEAATFASTIKEEVK

SEQ ID NO: 27019 - protein, 30 aa, artificial
  peptide fold or domain or sub-domain
MLPTPSAPSSRSTTNWEDPLRLSTAELPTL

SEQ ID NO: 27020 - protein, 25 aa, artificial
  peptide fold or domain or sub-domain
MPPNGHKLSRSHFLTSAKNVFYDLL

SEQ ID NO: 27021 - protein, 26 aa, artificial
  peptide fold or domain or sub-domain
MCVYMYVRCERVSVCVAGIAIYSCCF

SEQ ID NO: 27022 - protein, 30 aa, artificial
  peptide fold or domain or sub-domain
MCLCVCVRVCVWESASVCEPLGKGEKRTSR

SEQ ID NO: 27023 - protein, 19 aa, artificial
  peptide fold or domain or sub-domain
MRGQRMRRKKGGVDEGSTT

SEQ ID NO: 27024 - protein, 29 aa, artificial
  peptide fold or domain or sub-domain
MALLVYGFGKFFLISLNLNLMKNRIFRSS

SEQ ID NO: 27025 - protein, 27 aa, artificial
  peptide fold or domain or sub-domain
MRWEATATLSSDIATIVVDLAGHVYTI

SEQ ID NO: 27026 - protein, 24 aa, artificial
  peptide fold or domain or sub-domain
MHNTLKQIVYLMAHSTATNDAQRM

SEQ ID NO: 27027 - protein, 19 aa, artificial
  peptide fold or domain or sub-domain
MNINKSTKSNLQTTICLIK

SEQ ID NO: 27028 - protein, 24 aa, artificial
  peptide fold or domain or sub-domain
NQFRLTSTSWRREVNSTRINITNC

SEQ ID NO: 27029 - protein, 13 aa, artificial
  peptide fold or domain or sub-domain
MVINYVILMICVL

SEQ ID NO: 27030 - protein, 24 aa, artificial
  peptide fold or domain or sub-domain
QLDSLIRYFDAVGYPPKVQFLFLG

SEQ ID NO: 27031 - protein, 24 aa, artificial
  peptide fold or domain or sub-domain
QFPDLIRLFHRGGWPPTANYLFLG

SEQ ID NO: 27032 - protein, 24 aa, artificial
  peptide fold or domain or sub-domain
QSIHLLRILMTCDAPPTQKFLFLG

SEQ ID NO: 27033 - protein, 27 aa, artificial
  peptide fold or domain or sub-domain
NQKKFIEKKDRDRISNEIGLDDRQIKY

SEQ ID NO: 27034 - protein, 27 aa, artificial
  peptide fold or domain or sub-domain
AATSCFMMTSQFYINMNSSNNNFCYNF

SEQ ID NO: 27035 - protein, 30 aa, artificial
  peptide fold or domain or sub-domain
MNYLVFFSLALLVMTGRTVTREKRKDMMDL

SEQ ID NO: 27036 - protein, 24 aa, artificial
  peptide fold or domain or sub-domain
MVVHRFSNHGSNDKCNRDSLHGRT

SEQ ID NO: 27037 - protein, 29 aa, artificial
  peptide fold or domain or sub-domain
MNKISGNRNGRNVNKKYQKQIANCTVRER

SEQ ID NO: 27038 - protein, 22 aa, artificial
  peptide fold or domain or sub-domain
MRHTYAHTLTPGAGVAACGTFK

SEQ ID NO: 27039 - protein, 29 aa, artificial
  peptide fold or domain or sub-domain
MPIRISPYIITNPKKSSKIKSIYVGVARN

SEQ ID NO: 27040 - protein, 29 aa, artificial
  peptide fold or domain or sub-domain
VPWGVSILIKETSLLGSIEKCMHLNISGR

SEQ ID NO: 27041 - protein, 27 aa, artificial
  peptide fold or domain or sub-domain
RSVQNKKVYSCRNLTQDCPVDKRHRNR

SEQ ID NO: 27042 - protein, 30 aa, artificial
  peptide fold or domain or sub-domain
QSVLPYRKVGMDLLQDGQLNHGTGFSYEES

SEQ ID NO: 27043 - protein, 30 aa, artificial
  peptide fold or domain or sub-domain
FGKKYKKVNSMMYMNLSLLIFWSYNFFFYL

SEQ ID NO: 27044 - protein, 29 aa, artificial
  peptide fold or domain or sub-domain
MRMKALNFPQFTNTAAVRITEQTRNSICK

SEQ ID NO: 27045 - protein, 26 aa, artificial
  peptide fold or domain or sub-domain
APAHRANLTKEKLAKLDDVEVLPHSA

SEQ ID NO: 27046 - protein, 26 aa, artificial
  peptide fold or domain or sub-domain
AKFHSAKKATEKFDELEKVEILSHPT

SEQ ID NO: 27047 - protein, 24 aa, artificial
  peptide fold or domain or sub-domain
LKNSAQAFQRLMDTVCHGLEFVFV

SEQ ID NO: 27048 - protein, 25 aa, artificial
  peptide fold or domain or sub-domain
LQGASATFQRLMDKVLQGLEEYAAA

SEQ ID NO: 27049 - protein, 26 aa, artificial
  peptide fold or domain or sub-domain
IKNAPSIFQRAIVEHWVISAQTYATS

SEQ ID NO: 27050 - protein, 24 aa, artificial
  peptide fold or domain or sub-domain
LRNASQTFQRHIDIILSGLSNTAA

SEQ ID NO: 27051 - protein, 24 aa, artificial
  peptide fold or domain or sub-domain
LRNAASIFQRAIDYILREQIGKTC

SEQ ID NO: 27052 - protein, 26 aa, artificial
  peptide fold or domain or sub-domain
LCNAPSTFQRLMQVVLAGLEWQCCFV

SEQ ID NO: 27053 - protein, 25 aa, artificial
  peptide fold or domain or sub-domain
AVSSPSLFSFYTRNTPTGNDVEIIQ

SEQ ID NO: 27054 - protein, 27 aa, artificial
  peptide fold or domain or sub-domain
SVSGPLLFILFINDLLIDLEPDIHVSC

SEQ ID NO: 27055 - protein, 26 aa, artificial
  peptide fold or domain or sub-domain
SALGPVLFNIFINPLFEIPLHCSLSL

SEQ ID NO: 27056 - protein, 25 aa, artificial
  peptide fold or domain or sub-domain
AVMSATLYNILMADFEQDIHSVVIQ

SEQ ID NO: 27057 - protein, 25 aa, artificial
  peptide fold or domain or sub-domain
TVLAATLFNVFTADLPCDISSYIAL

SEQ ID NO: 27058 - protein, 27 aa, artificial
  peptide fold or domain or sub-domain
SPLGPTLFNIYIREVSLSNRQDVQLML

SEQ ID NO: 27059 - protein, 26 aa, artificial
  peptide fold or domain or sub-domain
SVLGPILCNVAMSKVLEPLPSDDIFV

SEQ ID NO: 27060 - protein, 25 aa, artificial
  peptide fold or domain or sub-domain
SVLGPCLFIIYVNDLPSGLSSVSKL

SEQ ID NO: 27061 - protein, 25 aa, artificial
  peptide fold or domain or sub-domain
SVLGPTLFSVFINDMPNTVRSNILL

SEQ ID NO: 27062 - protein, 25 aa, artificial
  peptide fold or domain or sub-domain
SALGPILFVMFVNDMPGIVRSGCKL

SEQ ID NO: 27063 - protein, 28 aa, artificial
  peptide fold or domain or sub-domain
SQLGPTLWKVAMTEISKIKLDNTANIVL

SEQ ID NO: 27064 - protein, 25 aa, artificial
  peptide fold or domain or sub-domain
SDIAPFLYTLFTADIPTTENTLIGT

SEQ ID NO: 27065 - protein, 29 aa, artificial
  peptide fold or domain or sub-domain
SALGPVLWNIAFDSVLGLADDEDNAKILC

SEQ ID NO: 27066 - protein, 30 aa, artificial
  peptide fold or domain or sub-domain
SVLGPLLFTADLPCPNAYHMADPRKALLAT

SEQ ID NO: 27067 - protein, 28 aa, artificial
  peptide fold or domain or sub-domain
NPLSTFLFCMATERLLRRLEERGIAFLA

SEQ ID NO: 27068 - protein, 20 aa, artificial
  peptide fold or domain or sub-domain
NNPPCCSGYVCEGVYCAVDV

SEQ ID NO: 27069 - protein, 14 aa, artificial
  peptide fold or domain or sub-domain
NHSFSSMFNIYIIF

SEQ ID NO: 27070 - protein, 28 aa, artificial
  peptide fold or domain or sub-domain
RHARCAVGGGALPFGAAVEVDALVELNN

SEQ ID NO: 27071 - protein, 22 aa, artificial
  peptide fold or domain or sub-domain
MVAAAVEGTCAPQHGPQPLHLH

SEQ ID NO: 27072 - protein, 30 aa, artificial
  peptide fold or domain or sub-domain
RIVNITPVNEEHKAEASKEQSKSTSDSSTS

SEQ ID NO: 27073 - protein, 25 aa, artificial
  peptide fold or domain or sub-domain
LQCLCFKQKRWDCQNLNLTERQVKI

SEQ ID NO: 27074 - protein, 19 aa, artificial
  peptide fold or domain or sub-domain
FFGKGWDNASLDTIFSSML

SEQ ID NO: 27075 - protein, 21 aa, artificial
  peptide fold or domain or sub-domain
MITKLPASSTQMFSTTNYLIN

SEQ ID NO: 27076 - protein, 18 aa, artificial
  peptide fold or domain or sub-domain
LSVTDDAFAGYTTQNPDL

SEQ ID NO: 27077 - protein, 18 aa, artificial
  peptide fold or domain or sub-domain
ITNGQEATVGQFPYQVGL

SEQ ID NO: 27078 - protein, 18 aa, artificial
  peptide fold or domain or sub-domain
ITNGYEAYPGLFPYQVGL

SEQ ID NO: 27079 - protein, 30 aa, artificial
  peptide fold or domain or sub-domain
KHFAFFGQPSYNAFNRNKFMTDFMTTFNQI

SEQ ID NO: 27080 - protein, 18 aa, artificial
  peptide fold or domain or sub-domain
SQPQEVDGVRGVEHNYKY

SEQ ID NO: 27081 - protein, 20 aa, artificial
  peptide fold or domain or sub-domain
ASYPVPQKLGMPALRPTMSQ

SEQ ID NO: 27082 - protein, 27 aa, artificial
  peptide fold or domain or sub-domain
GQQQRLAIARALIRDPEILLLDEATSA

SEQ ID NO: 27083 - protein, 17 aa, artificial
  peptide fold or domain or sub-domain
MVTWSQLTFSDMNSPIM

SEQ ID NO: 27084 - protein, 29 aa, artificial
  peptide fold or domain or sub-domain
MIEEIKNFLGIIILTYVFLKILLYFFVKY

SEQ ID NO: 27085 - protein, 28 aa, artificial
  peptide fold or domain or sub-domain
MGPGPNFSAPWGKGVLRKPEKWIQKPRS

SEQ ID NO: 27086 - protein, 28 aa, artificial
  peptide fold or domain or sub-domain
MGSRPKLFCPVGEGRSAKMGKMNTETPF

SEQ ID NO: 27087 - protein, 22 aa, artificial
  peptide fold or domain or sub-domain
KSYLPASLCFIIFFIGLKIILL

SEQ ID NO: 27088 - protein, 30 aa, artificial
  peptide fold or domain or sub-domain
MFRRTFTTAFQATRAARVSLLVKQLEGTTP

SEQ ID NO: 27089 - protein, 23 aa, artificial
  peptide fold or domain or sub-domain
MAIYGMYRNFHTMILLDTQSPGD

SEQ ID NO: 27090 - protein, 24 aa, artificial
  peptide fold or domain or sub-domain
TVPFEENNGTVRERVVDSFSVLLS

SEQ ID NO: 27091 - protein, 22 aa, artificial
  peptide fold or domain or sub-domain
LSIQAHPTKSHAEQLHKNFPDM

SEQ ID NO: 27092 - protein, 18 aa, artificial
  peptide fold or domain or sub-domain
IVLESVFLDDFFFWITEV

SEQ ID NO: 27093 - protein, 18 aa, artificial
  peptide fold or domain or sub-domain
IVVEVTSLNNFLKWTNKF

SEQ ID NO: 27094 - protein, 24 aa, artificial
  peptide fold or domain or sub-domain
MLRFVPRRLAIGAYTLFMMEQKNN

SEQ ID NO: 27095 - protein, 29 aa, artificial
  peptide fold or domain or sub-domain
IKELGDHITNLKRVGSGLGEYEYDKNLSS

SEQ ID NO: 27096 - protein, 27 aa, artificial
  peptide fold or domain or sub-domain
ENQKYLSPAERKRLAKGLQLTERQVKT

SEQ ID NO: 27097 - protein, 22 aa, artificial
  peptide fold or domain or sub-domain
LSIQAHPTKNHAEQLHKSFPDR

SEQ ID NO: 27098 - protein, 19 aa, artificial
  peptide fold or domain or sub-domain
IVPESVMSLDFFNWLYNFN

SEQ ID NO: 27099 - protein, 19 aa, artificial
  peptide fold or domain or sub-domain
IMIESTSMTNFINWMKMIK

SEQ ID NO: 27100 - protein, 21 aa, artificial
  peptide fold or domain or sub-domain
IVLESVDFLMYLNWVMNYYYD

SEQ ID NO: 27101 - protein, 21 aa, artificial
  peptide fold or domain or sub-domain
IVLESVMWDVFLHWMKSHKKH

SEQ ID NO: 27102 - protein, 21 aa, artificial
  peptide fold or domain or sub-domain
IVVESVKYCKFIKWINSMLIL

SEQ ID NO: 27103 - protein, 22 aa, artificial
  peptide fold or domain or sub-domain
IVVEAVPFEIYLQSMFEKLGVY

SEQ ID NO: 27104 - protein, 30 aa, artificial
  peptide fold or domain or sub-domain
VSKLLGEMWRQLPDEQKDKYRSESEQIRRK

SEQ ID NO: 27105 - protein, 19 aa, artificial
  peptide fold or domain or sub-domain
IMIESMLTKNFYKFIMKNI

SEQ ID NO: 27106 - protein, 24 aa, artificial
  peptide fold or domain or sub-domain
IMLESNSIRGFLIWVCYMLKNINF

SEQ ID NO: 27107 - protein, 14 aa, artificial
  peptide fold or domain or sub-domain
LTHSFNQIPIMTKI

SEQ ID NO: 27108 - protein, 14 aa, artificial
  peptide fold or domain or sub-domain
YNHSFKEIPIMVKT

SEQ ID NO: 27109 - protein, 22 aa, artificial
  peptide fold or domain or sub-domain
MQDLPQDQLIRKLTSVACTSQS

SEQ ID NO: 27110 - protein, 27 aa, artificial
  peptide fold or domain or sub-domain
MAAQFFNRIGQMGSEWRFGWRCQFGII

SEQ ID NO: 27111 - protein, 15 aa, artificial
  peptide fold or domain or sub-domain
PEVHQAFADAGQKPG

SEQ ID NO: 27112 - protein, 21 aa, artificial
  peptide fold or domain or sub-domain
SYLPASLCFICLFVGLKMIML

SEQ ID NO: 27113 - protein, 23 aa, artificial
  peptide fold or domain or sub-domain
SKKYLSLTERSHIAHLLKLSEVQ

SEQ ID NO: 27114 - protein, 30 aa, artificial
  peptide fold or domain or sub-domain
MGGRKKCLFGVKQIPTSTTSRVCCAVVIVI

SEQ ID NO: 27115 - protein, 29 aa, artificial
  peptide fold or domain or sub-domain
NSEICGANHSFMPINMEVIPTKVFTKFFN

SEQ ID NO: 27116 - protein, 30 aa, artificial
  peptide fold or domain or sub-domain
IVNGIPPSRESDSSLSAVEVAFDASYLTCE

SEQ ID NO: 27117 - protein, 29 aa, artificial
  peptide fold or domain or sub-domain
MQSVHGSDTSDTITNGLVDRAAEAVTGKS

SEQ ID NO: 27118 - protein, 28 aa, artificial
  peptide fold or domain or sub-domain
MNFFIPNEVKREGIYLQHQLGPPLIHQQ

SEQ ID NO: 27119 - protein, 25 aa, artificial
  peptide fold or domain or sub-domain
MVIFYIRFSLNVVQCIEVSATNVGN

SEQ ID NO: 27120 - protein, 28 aa, artificial
  peptide fold or domain or sub-domain
MFVAHFIIWKVVPPRLDRIYQTQFDEIE

SEQ ID NO: 27121 - protein, 30 aa, artificial
  peptide fold or domain or sub-domain
MPRQSMALRSGDLWCHHLERSLPCYPFANV

SEQ ID NO: 27122 - protein, 24 aa, artificial
  peptide fold or domain or sub-domain
MHSADLTTNDSLSYRVSNLWRMNR

SEQ ID NO: 27123 - protein, 29 aa, artificial
  peptide fold or domain or sub-domain
AAKCHCDTQSGWCDQYMLRDIFATIAWSV

SEQ ID NO: 27124 - protein, 29 aa, artificial
  peptide fold or domain or sub-domain
ERVAQNARCAKASPRTDIRTDEAPHHLWM

SEQ ID NO: 27125 - protein, 27 aa, artificial
  peptide fold or domain or sub-domain
VILLLLPLSLFTHFTQPIVQQYPPTFA

SEQ ID NO: 27126 - protein, 24 aa, artificial
  peptide fold or domain or sub-domain
MIEEFQLKVLIEAQRVRSVCIRSM

SEQ ID NO: 27127 - protein, 30 aa, artificial
  peptide fold or domain or sub-domain
MDNRKQPVCKCVCVSSKVSKQCVVNVMKQQ

SEQ ID NO: 27128 - protein, 29 aa, artificial
  peptide fold or domain or sub-domain
MILFLIDFLLQFYNTHTPAPQESTNERIL

SEQ ID NO: 27129 - protein, 23 aa, artificial
  peptide fold or domain or sub-domain
AELSVKSQEAMWCSIKSLDFSHL

SEQ ID NO: 27130 - protein, 19 aa, artificial
  peptide fold or domain or sub-domain
NCIRWTGNSREFQLCDPRE

SEQ ID NO: 27131 - protein, 28 aa, artificial
  peptide fold or domain or sub-domain
MLNSKSSSPWSVWTFDFSVNMKALIILG

SEQ ID NO: 27132 - protein, 24 aa, artificial
  peptide fold or domain or sub-domain
QGRLSPLPWLLPEIKNSLTEKKKK

SEQ ID NO: 27133 - protein, 29 aa, artificial
  peptide fold or domain or sub-domain
MSGIWVHLSLVSRLCPGEASPSSATGLAR

SEQ ID NO: 27134 - protein, 17 aa, artificial
  peptide fold or domain or sub-domain
YQPPSTNKKTKLQRRRK

SEQ ID NO: 27135 - protein, 23 aa, artificial
  peptide fold or domain or sub-domain
NSYFQGISIDETALVSLYFMQLN

SEQ ID NO: 27136 - protein, 20 aa, artificial
  peptide fold or domain or sub-domain
MSKMSEEEEFYLFNISSVGP

SEQ ID NO: 27137 - protein, 29 aa, artificial
  peptide fold or domain or sub-domain
IEQERIDKIWPKLRVLARSSPTDKDTLVK

SEQ ID NO: 27138 - protein, 22 aa, artificial
  peptide fold or domain or sub-domain
STRGMCSSLPARTTRKTGSWPP

SEQ ID NO: 27139 - protein, 28 aa, artificial
  peptide fold or domain or sub-domain
ARNRVVRTEFHLHEKPTKVITCYRINFN

SEQ ID NO: 27140 - protein, 27 aa, artificial
  peptide fold or domain or sub-domain
GIYKKAQHPQKTHHGKYEIPAQPPTCV

SEQ ID NO: 27141 - protein, 15 aa, artificial
  peptide fold or domain or sub-domain
PAASYLEGMNGGLCL

SEQ ID NO: 27142 - protein, 26 aa, artificial
  peptide fold or domain or sub-domain
MQSSGATPCVVLCGSLLSFGSKKKTQ

SEQ ID NO: 27143 - protein, 20 aa, artificial
  peptide fold or domain or sub-domain
AVNTHRDKPTAETSRAAHRL

SEQ ID NO: 27144 - protein, 27 aa, artificial
  peptide fold or domain or sub-domain
MKSSGLMPFVLLALGILAPWAVEGAEN

SEQ ID NO: 27145 - protein, 15 aa, artificial
  peptide fold or domain or sub-domain
MSLQMITVRNNIALI

SEQ ID NO: 27146 - protein, 26 aa, artificial
  peptide fold or domain or sub-domain
MADTAPNGPQGAGAVGILHISGSILR

SEQ ID NO: 27147 - protein, 15 aa, artificial
  peptide fold or domain or sub-domain
MAPPVWTLVLLVGAA

SEQ ID NO: 27148 - protein, 29 aa, artificial
  peptide fold or domain or sub-domain
MNMLNFLNKKNEPCLYLQLTGEKKLRSYR

SEQ ID NO: 27149 - protein, 26 aa, artificial
  peptide fold or domain or sub-domain
TRLVGCFIIAGVALCIFLYVGGRRRC

SEQ ID NO: 27150 - protein, 17 aa, artificial
  peptide fold or domain or sub-domain
MREIVHIQAGQCGNQIG

SEQ ID NO: 27151 - protein, 12 aa, artificial
  peptide fold or domain or sub-domain
SNNVAEEWKYVA

SEQ ID NO: 27152 - protein, 20 aa, artificial
  peptide fold or domain or sub-domain
MWGDLWLLSPAFPSPGTGTE

SEQ ID NO: 27153 - protein, 17 aa, artificial
  peptide fold or domain or sub-domain
AQKLMDQAPRAMIENFS

SEQ ID NO: 27154 - protein, 29 aa, artificial
  peptide fold or domain or sub-domain
GPTALLAHEIGFGSKVTTHPLAKDKMMNG

SEQ ID NO: 27155 - protein, 30 aa, artificial
  peptide fold or domain or sub-domain
SVTCDETCKAFQICAIMYLDVISYTDCLKH

SEQ ID NO: 27156 - protein, 24 aa, artificial
  peptide fold or domain or sub-domain
MLPGPVPVGFALSTQRPHLVEVDI

SEQ ID NO: 27157 - protein, 25 aa, artificial
  peptide fold or domain or sub-domain
KCCCQDLDLSSLVDESIQLQVSHQL

SEQ ID NO: 27158 - protein, 19 aa, artificial
  peptide fold or domain or sub-domain
VWRESQPDATSNRPPLTSS

SEQ ID NO: 27159 - protein, 29 aa, artificial
  peptide fold or domain or sub-domain
HFVSVIVALEKLKKISLPCSQPLQEDDLK

SEQ ID NO: 27160 - protein, 24 aa, artificial
  peptide fold or domain or sub-domain
FVREPPSLCGCPSLSSKSPGVPQV

SEQ ID NO: 27161 - protein, 28 aa, artificial
  peptide fold or domain or sub-domain
NDHVFIKNFTDLDIREKIMCFGGILHVR

SEQ ID NO: 27162 - protein, 21 aa, artificial
  peptide fold or domain or sub-domain
TAAILSRVSQSLLSVNPGLKT

SEQ ID NO: 27163 - protein, 23 aa, artificial
  peptide fold or domain or sub-domain
VTEVIHGEPIIKKYTKIIDGVPV

SEQ ID NO: 27164 - protein, 21 aa, artificial
  peptide fold or domain or sub-domain
LMHRLFVTSCSWGKGVAKQTP

SEQ ID NO: 27165 - protein, 27 aa, artificial
  peptide fold or domain or sub-domain
MSGKMTLCIPRGFWTAAVMMILVAEGR

SEQ ID NO: 27166 - protein, 14 aa, artificial
  peptide fold or domain or sub-domain
DESHRAEHIESRTL

SEQ ID NO: 27167 - protein, 24 aa, artificial
  peptide fold or domain or sub-domain
MRGQGRKESLSDSRDLDGSYDQLT

SEQ ID NO: 27168 - protein, 17 aa, artificial
  peptide fold or domain or sub-domain
MDIAIHHPWIRRPFFLP

SEQ ID NO: 27169 - protein, 27 aa, artificial
  peptide fold or domain or sub-domain
MEFDCEGVRRLLGKVRAVRWASTSSGT

SEQ ID NO: 27170 - protein, 12 aa, artificial
  peptide fold or domain or sub-domain
MWGDPRPANRTG

SEQ ID NO: 27171 - protein, 30 aa, artificial
  peptide fold or domain or sub-domain
LEAPYKKTCLTISHLYSHEFTFDSSVNCQS

SEQ ID NO: 27172 - protein, 15 aa, artificial
  peptide fold or domain or sub-domain
MADGPRCKRRKQDVQ

SEQ ID NO: 27173 - protein, 25 aa, artificial
  peptide fold or domain or sub-domain
MTLEEFSAGEQKTEIHIHRSGRILP

SEQ ID NO: 27174 - protein, 23 aa, artificial
  peptide fold or domain or sub-domain
GTYYSEAHSEPRPGKSAAVSSLD

SEQ ID NO: 27175 - protein, 13 aa, artificial
  peptide fold or domain or sub-domain
MIQTVPDPAAHIK

SEQ ID NO: 27176 - protein, 16 aa, artificial
  peptide fold or domain or sub-domain
ITLIINPACCFFPVLG

SEQ ID NO: 27177 - protein, 16 aa, artificial
  peptide fold or domain or sub-domain
MKPDASFLFGSKLERK

SEQ ID NO: 27178 - protein, 22 aa, artificial
  peptide fold or domain or sub-domain
YLAVSCVLFLAARLSPYEWYNP

SEQ ID NO: 27179 - protein, 13 aa, artificial
  peptide fold or domain or sub-domain
ARFAEKEELMLVH

SEQ ID NO: 27180 - protein, 29 aa, artificial
  peptide fold or domain or sub-domain
SQMIQQSDDNPSNSLCEAPLNIAHDALCS

SEQ ID NO: 27181 - protein, 13 aa, artificial
  peptide fold or domain or sub-domain
MTMTMTLHSHSVR

SEQ ID NO: 27182 - protein, 24 aa, artificial
  peptide fold or domain or sub-domain
HRAYHQRRKHHLAWGSAIIQGIPG

SEQ ID NO: 27183 - protein, 23 aa, artificial
  peptide fold or domain or sub-domain
ALSRSTVPWQGTMTSKIHLCRDA

SEQ ID NO: 27184 - protein, 23 aa, artificial
  peptide fold or domain or sub-domain
VTSGLNSTIHKASNYKNNTVLYE

SEQ ID NO: 27185 - protein, 16 aa, artificial
  peptide fold or domain or sub-domain
MLATRVFSLIGKRAIY

SEQ ID NO: 27186 - protein, 23 aa, artificial
  peptide fold or domain or sub-domain
ARQFRPDPGEARAGCKTSSTSSR

SEQ ID NO: 27187 - protein, 29 aa, artificial
  peptide fold or domain or sub-domain
KQEKDGTEKRGRGRPRKQPPVSPGTALVG

SEQ ID NO: 27188 - protein, 21 aa, artificial
  peptide fold or domain or sub-domain
TIEKFEKEAAEVGKGITIGAS

SEQ ID NO: 27189 - protein, 16 aa, artificial
  peptide fold or domain or sub-domain
VQNMRTIRPMDMETIE

SEQ ID NO: 27190 - protein, 19 aa, artificial
  peptide fold or domain or sub-domain
AEMAKQKAPPEAKVQKVEG

SEQ ID NO: 27191 - protein, 11 aa, artificial
  peptide fold or domain or sub-domain
EPQKSCSKYTD

SEQ ID NO: 27192 - protein, 18 aa, artificial
  peptide fold or domain or sub-domain
SPGGAMAAGSITTLPALP

SEQ ID NO: 27193 - protein, 11 aa, artificial
  peptide fold or domain or sub-domain
HSDAVFTYNYR

SEQ ID NO: 27194 - protein, 20 aa, artificial
  peptide fold or domain or sub-domain
LYSSRDDVFELTHFNFSRTS

SEQ ID NO: 27195 - protein, 29 aa, artificial
  peptide fold or domain or sub-domain
APQPWQCAPCSPEKLALCPPVPDSCTQSA

SEQ ID NO: 27196 - protein, 20 aa, artificial
  peptide fold or domain or sub-domain
IVNYQTAPFDSRFPHQNQTR

SEQ ID NO: 27197 - protein, 18 aa, artificial
  peptide fold or domain or sub-domain
SDALQGPTSYHVMEISSF

SEQ ID NO: 27198 - protein, 25 aa, artificial
  peptide fold or domain or sub-domain
FKSDPGQLENCREAIKELFENTNMK

SEQ ID NO: 27199 - protein, 19 aa, artificial
  peptide fold or domain or sub-domain
VLGIRGDALDKFQPQQPLD

SEQ ID NO: 27200 - protein, 30 aa, artificial
  peptide fold or domain or sub-domain
MVHSDLGIEELDSPESSLNGSEDMVREHET

SEQ ID NO: 27201 - protein, 29 aa, artificial
  peptide fold or domain or sub-domain
EVDADGEPHRALGSPTPGNGTIDFPEFLT

SEQ ID NO: 27202 - protein, 28 aa, artificial
  peptide fold or domain or sub-domain
TEAVTCAKRVVRDPQGIKAWVAWRTHCQ

SEQ ID NO: 27203 - protein, 20 aa, artificial [sequence omitted]

SEQ ID NO: 27204 - protein, 12 aa, artificial
  peptide fold or domain or sub-domain
ERTYKFFEQMQN

SEQ ID NO: 27205 - protein, 25 aa, artificial
  peptide fold or domain or sub-domain
MNENLFASFITPMIMGLPLATLIVL

SEQ ID NO: 27206 - protein, 15 aa, artificial
  peptide fold or domain or sub-domain
PDQEFGIDLSPVCFL

SEQ ID NO: 27207 - protein, 20 aa, artificial
  peptide fold or domain or sub-domain
LSARGTVGIMIGVLARVALI

SEQ ID NO: 27208 - protein, 21 aa, artificial
  peptide fold or domain or sub-domain
TAAILSRESWSLQSVNPDLKT

SEQ ID NO: 27209 - protein, 25 aa, artificial
  peptide fold or domain or sub-domain
KYQYLLSRVYDGKMYTGLCTFVERW

SEQ ID NO: 27210 - protein, 25 aa, artificial
  peptide fold or domain or sub-domain
PPVHTEAVVPQAPSTFGKKGKKLWA

SEQ ID NO: 27211 - protein, 29 aa, artificial
  peptide fold or domain or sub-domain
DSRKNVLGHMQQVGKTPQSWPSPGSHNPQ

SEQ ID NO: 27212 - protein, 30 aa, artificial
  peptide fold or domain or sub-domain
GTDELLGVMDQVTIINSTLGKALGGASGGY

SEQ ID NO: 27213 - protein, 15 aa, artificial
  peptide fold or domain or sub-domain
VECHWFDGDLCHWDG

SEQ ID NO: 27214 - protein, 23 aa, artificial
  peptide fold or domain or sub-domain
EGLQGDAVQETDDPEHQPAHHKI

SEQ ID NO: 27215 - protein, 26 aa, artificial
  peptide fold or domain or sub-domain
STETENCEDKQNTCLVISCDDPGING

SEQ ID NO: 27216 - protein, 16 aa, artificial
  peptide fold or domain or sub-domain
FNLDTREDNVIEKTGD

SEQ ID NO: 27217 - protein, 18 aa, artificial
  peptide fold or domain or sub-domain
PEPAKSAPAPKKGSKEEV

SEQ ID NO: 27218 - protein, 16 aa, artificial
  peptide fold or domain or sub-domain
MATADEIVHMLNHMTD

SEQ ID NO: 27219 - protein, 14 aa, artificial
  peptide fold or domain or sub-domain
LIDEGGAAWPNVAK

SEQ ID NO: 27220 - protein, 17 aa, artificial
  peptide fold or domain or sub-domain
VLAQNSGFDLQEAVTLV

SEQ ID NO: 27221 - protein, 26 aa, artificial
  peptide fold or domain or sub-domain
ADTETETNEENIRKTCPVIACGPGIN

SEQ ID NO: 27222 - protein, 16 aa, artificial
  peptide fold or domain or sub-domain
TPANEVNIPAQITEMF

SEQ ID NO: 27223 - protein, 15 aa, artificial
  peptide fold or domain or sub-domain
LDQVGGLGRFQILQR

SEQ ID NO: 27224 - protein, 15 aa, artificial
  peptide fold or domain or sub-domain
AQNRGPDELGGVLYD

SEQ ID NO: 27225 - protein, 21 aa, artificial
  peptide fold or domain or sub-domain
GPLVEAQPNVSSLLVEDDLAV

SEQ ID NO: 27226 - protein, 19 aa, artificial
  peptide fold or domain or sub-domain
TLEEAIRSDTSGHFQRLLI

SEQ ID NO: 27227 - protein, 27 aa, artificial
  peptide fold or domain or sub-domain
MPPELFLDLYSPPPRAIYIFALKNGIP

SEQ ID NO: 27228 - protein, 28 aa, artificial
  peptide fold or domain or sub-domain
MAVESQDRRPLVLGLLLCVLGPVVCHAG

SEQ ID NO: 27229 - protein, 29 aa, artificial
  peptide fold or domain or sub-domain
MAVESQGGHPLVLGLLLCVLGPVVSHAGK

SEQ ID NO: 27230 - protein, 29 aa, artificial
  peptide fold or domain or sub-domain
GSWNVILFVCFEQLKQELMESRQTVDCAA

SEQ ID NO: 27231 - protein, 27 aa, artificial
  peptide fold or domain or sub-domain
IVKSVLRFIVKRMYPVSVNCFIAGKGG

SEQ ID NO: 27232 - protein, 27 aa, artificial
  peptide fold or domain or sub-domain
IKLHPESKDEKRGGCYEDAVHSGAIED

SEQ ID NO: 27233 - protein, 30 aa, artificial
  peptide fold or domain or sub-domain
AQIEYLPPAFCLEPPYTGPCKARMIKYFYN

SEQ ID NO: 27234 - protein, 26 aa, artificial
  peptide fold or domain or sub-domain
KKGRMKGSETLKPDNFEESGYTFIAP

SEQ ID NO: 27235 - protein, 27 aa, artificial
  peptide fold or domain or sub-domain
FDKALKALPMHIQLAFNPTQLEGQCHV

SEQ ID NO: 27236 - protein, 27 aa, artificial
  peptide fold or domain or sub-domain
GLLVNLKTVVSWLSWLQYLSIPRYGYA

SEQ ID NO: 27237 - protein, 30 aa, artificial
  peptide fold or domain or sub-domain
RGLGHAGSHRHGYCLQSALSWRNPTLGWCP

SEQ ID NO: 27238 - protein, 29 aa, artificial
  peptide fold or domain or sub-domain
WRCGWIQTALGVAVGHGVGIALPATLLPG

SEQ ID NO: 27239 - protein, 23 aa, artificial
  peptide fold or domain or sub-domain
PSTPLTQRASESVVLMTGDTDPP

SEQ ID NO: 27240 - protein, 14 aa, artificial
  peptide fold or domain or sub-domain
EARGKNCGSWCIAW

SEQ ID NO: 27241 - protein, 26 aa, artificial
  peptide fold or domain or sub-domain
AHIPNKVEGLDIREVAGTWHSVAMAA

SEQ ID NO: 27242 - protein, 26 aa, artificial
  peptide fold or domain or sub-domain
VDIPQSKKDLDIWKLAGTWHSMAMAA

SEQ ID NO: 27243 - protein, 21 aa, artificial
  peptide fold or domain or sub-domain
MPILGKDPHKMAAKTPSSEES

SEQ ID NO: 27244 - protein, 23 aa, artificial
  peptide fold or domain or sub-domain
NPVAEVFTQEPLEFGKPNTLICF

SEQ ID NO: 27245 - protein, 11 aa, artificial
  peptide fold or domain or sub-domain
EQLLRMKENSQ

SEQ ID NO: 27246 - protein, 27 aa, artificial
  peptide fold or domain or sub-domain
MAKLRLYKKISSAWWPEPVVPATLEAE

SEQ ID NO: 27247 - protein, 29 aa, artificial
  peptide fold or domain or sub-domain
ALFRLRTCVLSSSFSVPVEVIFSPEKEIL

SEQ ID NO: 27248 - protein, 29 aa, artificial
  peptide fold or domain or sub-domain
LPNSANSSTSWRRLRNGLTLPSPRSTSCG

SEQ ID NO: 27249 - protein, 18 aa, artificial
  peptide fold or domain or sub-domain
ESGRHGRRKQYPISLVLA

SEQ ID NO: 27250 - protein, 27 aa, artificial
  peptide fold or domain or sub-domain
MAKPRLYKEISPAWWPEPVVPVTREAE

SEQ ID NO: 27251 - protein, 13 aa, artificial
  peptide fold or domain or sub-domain
TRHGPACVDTPEE

SEQ ID NO: 27252 - protein, 19 aa, artificial
  peptide fold or domain or sub-domain
RFQFYFQQKGRLTSLHPSS

SEQ ID NO: 27253 - protein, 30 aa, artificial
  peptide fold or domain or sub-domain
LPTRVAQCHRWQWRMKKLGAPSITCVRRAF

SEQ ID NO: 27254 - protein, 28 aa, artificial
  peptide fold or domain or sub-domain
GLMSEECGRTAALAAGRSRKGAGEEGLV

SEQ ID NO: 27255 - protein, 29 aa, artificial
  peptide fold or domain or sub-domain
MEEQGCKQFCEKIFKKFYGILGSGGTIKR

SEQ ID NO: 27256 - protein, 19 aa, artificial
  peptide fold or domain or sub-domain
MSTENPNAGELKPLGVRGF

SEQ ID NO: 27257 - protein, 29 aa, artificial
  peptide fold or domain or sub-domain
MNHYTVEILINMYALGRQFGWNSNFRQKR

SEQ ID NO: 27258 - protein, 30 aa, artificial
  peptide fold or domain or sub-domain
MSTVAVLFVVTIIIVPISGKIKRESSQNTE

SEQ ID NO: 27259 - protein, 30 aa, artificial
  peptide fold or domain or sub-domain
MGTSPREAGDGCEATPERRDVEGEIRRERR

SEQ ID NO: 27260 - protein, 28 aa, artificial
  peptide fold or domain or sub-domain
MRKEYNDRWTAELREPYASEQQDDDEED

SEQ ID NO: 27261 - protein, 28 aa, artificial
  peptide fold or domain or sub-domain
MNDKQRVYITGIGWVVRRGNSYSLEGRK

SEQ ID NO: 27262 - protein, 28 aa, artificial
  peptide fold or domain or sub-domain
MISKMPDWIFVAALLILLGILIMYVGSL

SEQ ID NO: 27263 - protein, 28 aa, artificial
  peptide fold or domain or sub-domain
MKMNNNISRFIICYNTNCKYYWECVLLM

SEQ ID NO: 27264 - protein, 24 aa, artificial
  peptide fold or domain or sub-domain
RKRANDIALKCKYCEKEFYTKLAL

SEQ ID NO: 27265 - protein, 21 aa, artificial
  peptide fold or domain or sub-domain
MPVLNVLCQSWRGSRVVMQLH

SEQ ID NO: 27266 - protein, 26 aa, artificial
  peptide fold or domain or sub-domain
MTLIQAIWKRLCSNPFSFPGQYQNKA

SEQ ID NO: 27267 - protein, 22 aa, artificial
  peptide fold or domain or sub-domain
MDAKHEKRFVSLFDLHDSFRPD

SEQ ID NO: 27268 - protein, 27 aa, artificial
  peptide fold or domain or sub-domain
MFRLDVLFVIALLIVVYIIAASGSGTC

SEQ ID NO: 27269 - protein, 25 aa, artificial
  peptide fold or domain or sub-domain
MRLPFLGPAFSLSMKESPTNQRKEK

SEQ ID NO: 27270 - protein, 30 aa, artificial
  peptide fold or domain or sub-domain
MSCYRIAAPSDEWRGNSSQPRAARNRHGRE

SEQ ID NO: 27271 - protein, 26 aa, artificial
  peptide fold or domain or sub-domain
MPRFATVTCVRLFHGYAMRDIVISIT

SEQ ID NO: 27272 - protein, 24 aa, artificial
  peptide fold or domain or sub-domain
MTGDRIVDKTLLLTMVYILVKYLV

SEQ ID NO: 27273 - protein, 30 aa, artificial
  peptide fold or domain or sub-domain
MIIKEIKGNAVELFLNRDVHLIHGVVTGFW

SEQ ID NO: 27274 - protein, 28 aa, artificial
  peptide fold or domain or sub-domain
MIERENVNVMVELGDRVKVDNPVDLQLN

SEQ ID NO: 27275 - protein, 28 aa, artificial
  peptide fold or domain or sub-domain
MTPMEITGIIAAAFVITAFQFRLFGLLK

SEQ ID NO: 27276 - protein, 27 aa, artificial
  peptide fold or domain or sub-domain
MYIDIHGKTGRRLYAEWSIPTKEYEEA

SEQ ID NO: 27277 - protein, 26 aa, artificial
  peptide fold or domain or sub-domain
MNNVGLEIIFWTALTLYLLTRIGLFR

SEQ ID NO: 27278 - protein, 29 aa, artificial
  peptide fold or domain or sub-domain
MTFWRAAAIGVVIAAGYMVGQVIVMLGSC

SEQ ID NO: 27279 - protein, 30 aa, artificial
  peptide fold or domain or sub-domain
MYAPLDQQRESARDDGPSAKYRCRNRHGAP

SEQ ID NO: 27280 - protein, 30 aa, artificial
  peptide fold or domain or sub-domain
MKLSILAVGLPLTAAIAMCIYLVLKASISL

SEQ ID NO: 27281 - protein, 30 aa, artificial
  peptide fold or domain or sub-domain
MKEFEALESIYGEDACYSREDNKIYYTRAD

SEQ ID NO: 27282 - protein, 30 aa, artificial
  peptide fold or domain or sub-domain
MLDHGDTYNMADNRVELDRFNMVARMYETE

SEQ ID NO: 27283 - protein, 26 aa, artificial
  peptide fold or domain or sub-domain
MLERQLQYLVPNRQPSASPAKALPLT

SEQ ID NO: 27284 - protein, 28 aa, artificial
  peptide fold or domain or sub-domain
MIIDRATIATGAALIGLSVAYLVLGLVW

SEQ ID NO: 27285 - protein, 30 aa, artificial
  peptide fold or domain or sub-domain
MIDEGKEIKAEWLPGGEDQLAYLIGKGLVK

SEQ ID NO: 27286 - protein, 28 aa, artificial
  peptide fold or domain or sub-domain
MAARPRECGAGFLPQNHIYARGGGADSK

SEQ ID NO: 27287 - protein, 27 aa, artificial
  peptide fold or domain or sub-domain
MTIYITELITGLLVIAGLFIWGRGKCG

SEQ ID NO: 27288 - protein, 30 aa, artificial
  peptide fold or domain or sub-domain
MKILTDYECKHCGESLMFAGSRCLHCGREQ

SEQ ID NO: 27289 - protein, 18 aa, artificial
  peptide fold or domain or sub-domain
MLLRLLYSRFGKFIKRRI

SEQ ID NO: 27290 - protein, 18 aa, artificial
  peptide fold or domain or sub-domain
MTILATFVTIILSLTFYL

SEQ ID NO: 27291 - protein, 29 aa, artificial
  peptide fold or domain or sub-domain
MTKARFLRDTVKVLEAGSVTESTKIWCKS

SEQ ID NO: 27292 - protein, 28 aa, artificial
  peptide fold or domain or sub-domain
MRYMTVQDIRDIMVSKYKSNEFVTDKSR

SEQ ID NO: 27293 - protein, 25 aa, artificial
  peptide fold or domain or sub-domain
MYIPMEAVVGIACLLVGFVIGLIAQ

SEQ ID NO: 27294 - protein, 22 aa, artificial
  peptide fold or domain or sub-domain
MKKLYRRVSAYLWYLYWRITGR

SEQ ID NO: 27295 - protein, 20 aa, artificial
  peptide fold or domain or sub-domain
MIYLLAIFLHIYGRPVEWDE

SEQ ID NO: 27296 - protein, 29 aa, artificial
  peptide fold or domain or sub-domain
MLIALHDIQLIIFALLGGMSGFIAALNFR

SEQ ID NO: 27297 - protein, 25 aa, artificial
  peptide fold or domain or sub-domain
MQDRSKIDEDLKTLTMAQRGGLSHR

SEQ ID NO: 27298 - protein, 25 aa, artificial
  peptide fold or domain or sub-domain
MSGLDNGLYHRLDIIRFIPSMWGGG

SEQ ID NO: 27299 - protein, 27 aa, artificial
  peptide fold or domain or sub-domain
MDVATACLVLIAFLVGGVLIGFLDSVF

SEQ ID NO: 27300 - protein, 28 aa, artificial
  peptide fold or domain or sub-domain
MRRKKKKPVKKFVVLQAIGDILLSLIGF

SEQ ID NO: 27301 - protein, 29 aa, artificial
  peptide fold or domain or sub-domain
MIDNWKLQMFTDICQTVVILMLIFWKKDK

SEQ ID NO: 27302 - protein, 26 aa, artificial
  peptide fold or domain or sub-domain
MNVNAVLLHLLNGFSIIFFRLYSFSC

SEQ ID NO: 27303 - protein, 25 aa, artificial
  peptide fold or domain or sub-domain
MWIILFAIVATLGLMVADDNIWPDC

SEQ ID NO: 27304 - protein, 27 aa, artificial
  peptide fold or domain or sub-domain
MLLVRSEDDYKNKSYIESALHFSFIIL

SEQ ID NO: 27305 - protein, 28 aa, artificial
  peptide fold or domain or sub-domain
MDVFAVMILVSFMSVIAGYWMRGSDKRG

SEQ ID NO: 27306 - protein, 29 aa, artificial
  peptide fold or domain or sub-domain
MKGALAMVYAGLWIMAALIFFLTISEVAL

SEQ ID NO: 27307 - protein, 29 aa, artificial
  peptide fold or domain or sub-domain
MTPLRAVPGMLARADNASAAKLDGMRGMP

SEQ ID NO: 27308 - protein, 27 aa, artificial
  peptide fold or domain or sub-domain
MRPGKFKKANWSKEYKEYLLSLVKRNS

SEQ ID NO: 27309 - protein, 27 aa, artificial
  peptide fold or domain or sub-domain
TDRGRRARRACFCGKVFDGELSFALKL

SEQ ID NO: 27310 - protein, 29 aa, artificial
  peptide fold or domain or sub-domain
MRKWTDKQQPCDNAAGLTPLGTIAKQVQL

SEQ ID NO: 27311 - protein, 23 aa, artificial
  peptide fold or domain or sub-domain
MMIYSGLYSSNASKIWRRDWRPG

SEQ ID NO: 27312 - protein, 26 aa, artificial
  peptide fold or domain or sub-domain
MTVAIIVSSIGIVYFFFRDWKEEMGI

SEQ ID NO: 27313 - protein, 30 aa, artificial
  peptide fold or domain or sub-domain
MMYLMPLLIVIVGCLALYCSDDDDMPNGHA

SEQ ID NO: 27314 - protein, 22 aa, artificial
  peptide fold or domain or sub-domain
MASSRHQMQCTKYNKSLHTHGT

SEQ ID NO: 27315 - protein, 27 aa, artificial
  peptide fold or domain or sub-domain
GFEIFSFVGLFNLLRRVTKLAVAKYEY

SEQ ID NO: 27316 - protein, 28 aa, artificial
  peptide fold or domain or sub-domain
MPNCASASPTHQSLQVPVHAVMVLMGMM

SEQ ID NO: 27317 - protein, 27 aa, artificial
  peptide fold or domain or sub-domain
MQKGNNIPYARIQRAIAALDLFLVKGE

SEQ ID NO: 27318 - protein, 22 aa, artificial
  peptide fold or domain or sub-domain
GKAALAESTGLDAKQINNWFTT

SEQ ID NO: 27319 - protein, 25 aa, artificial
  peptide fold or domain or sub-domain
MVLIFQPDLLLYLFDKPFFLGSSER

SEQ ID NO: 27320 - protein, 21 aa, artificial
  peptide fold or domain or sub-domain
MLSVRLVGIELFILFRSYGEF

SEQ ID NO: 27321 - protein, 26 aa, artificial
  peptide fold or domain or sub-domain
MNNFWIQSPAVIYPQFPFGVRPVKVS

SEQ ID NO: 27322 - protein, 11 aa, artificial
  peptide fold or domain or sub-domain
EKFLKGASTID

SEQ ID NO: 27323 - protein, 18 aa, artificial
  peptide fold or domain or sub-domain
KEMKKSMIYDPFIRHFPF

SEQ ID NO: 27324 - protein, 20 aa, artificial
  peptide fold or domain or sub-domain
RDVDVGSFLPKSPSDPSMVL

SEQ ID NO: 27325 - protein, 20 aa, artificial
  peptide fold or domain or sub-domain
LVVETADRSGEFDTEGLLAK

SEQ ID NO: 27326 - protein, 15 aa, artificial
  peptide fold or domain or sub-domain
RMAATVGNYDYIIDY

SEQ ID NO: 27327 - protein, 29 aa, artificial
  peptide fold or domain or sub-domain
MRVDAEFRSKMMQALDRRRKRNEKYPHMF

SEQ ID NO: 27328 - protein, 22 aa, artificial
  peptide fold or domain or sub-domain
MMDDDALRSMSTTSRCAASRKA

SEQ ID NO: 27329 - protein, 21 aa, artificial
  peptide fold or domain or sub-domain
MNCAHRLIVSEDVTVDVAQLL

SEQ ID NO: 27330 - protein, 23 aa, artificial
  peptide fold or domain or sub-domain
MCVVELSGVPELCIPAITPSFGK

SEQ ID NO: 27331 - protein, 30 aa, artificial
  peptide fold or domain or sub-domain
MRRLLGLIRTDTVSAYHTFHMGKQYENRRF

SEQ ID NO: 27332 - protein, 22 aa, artificial
  peptide fold or domain or sub-domain
MREIAHDHTPVPVAEMSDEAEN

SEQ ID NO: 27333 - protein, 27 aa, artificial
  peptide fold or domain or sub-domain
MEDPFICLFAEFKRLHDSTRQASSCRW

SEQ ID NO: 27334 - protein, 23 aa, artificial
  peptide fold or domain or sub-domain
MGKQKFLTYAMFCSDYCRLNTSM

SEQ ID NO: 27335 - protein, 21 aa, artificial
  peptide fold or domain or sub-domain
MYGQTQHGPAVHHHHYVVSDA

SEQ ID NO: 27336 - protein, 24 aa, artificial
  peptide fold or domain or sub-domain
MHFTMEQATNLTLSLSYVALRKQE

SEQ ID NO: 27337 - protein, 21 aa, artificial
  peptide fold or domain or sub-domain
MKISWNVCTSCALAVFLIFLP

SEQ ID NO: 27338 - protein, 28 aa, artificial
  peptide fold or domain or sub-domain
MIFLNHQGTNTQRSVLFVVDSSTWLRAT

SEQ ID NO: 27339 - protein, 30 aa, artificial
  peptide fold or domain or sub-domain
MESDDVRTYLFEPSATNETSEARANATAGV

SEQ ID NO: 27340 - protein, 27 aa, artificial
  peptide fold or domain or sub-domain
MNNTRTWKRSRLYGYAHNTQEYPNFEM

SEQ ID NO: 27341 - protein, 23 aa, artificial
  peptide fold or domain or sub-domain
MTAKLGPNADPGGECPFDCWCCF

SEQ ID NO: 27342 - protein, 22 aa, artificial
  peptide fold or domain or sub-domain
SIAAPYLAKLPNKQSRSISLTY

SEQ ID NO: 27343 - protein, 29 aa, artificial
  peptide fold or domain or sub-domain
AVAEEDGEEAVAAEDRVIDRLYSSENQIL

SEQ ID NO: 27344 - protein, 29 aa, artificial
  peptide fold or domain or sub-domain
HFKIILENKKQTLKTSTKLSKYRSNRRKP

SEQ ID NO: 27345 - protein, 25 aa, artificial
  peptide fold or domain or sub-domain
MHCLDLGLVFSLQEQNQSQRLLDGY

SEQ ID NO: 27346 - protein, 23 aa, artificial
  peptide fold or domain or sub-domain
MPYKLRNIRKMSNRYLQRKTFSL

SEQ ID NO: 27347 - protein, 24 aa, artificial
  peptide fold or domain or sub-domain
MKIVTDLLPIYRSASYTKRSRGSG

SEQ ID NO: 27348 - protein, 29 aa, artificial
  peptide fold or domain or sub-domain
MKTKEDCSFPLSKRYFRRKRKLFFFFFLK

SEQ ID NO: 27349 - protein, 27 aa, artificial
  peptide fold or domain or sub-domain
RIGYPEVRLITSETTRPESRSTVISCV

SEQ ID NO: 27350 - protein, 21 aa, artificial
  peptide fold or domain or sub-domain
MSCAMPTILALKATEQFFLPV

SEQ ID NO: 27351 - protein, 30 aa, artificial
  peptide fold or domain or sub-domain
KADHFGPAIHHRYAGRDGIPSLQLVLIVSN

SEQ ID NO: 27352 - protein, 17 aa, artificial
  peptide fold or domain or sub-domain
MGSSELTVLFLFAGSMN

SEQ ID NO: 27353 - protein, 27 aa, artificial
  peptide fold or domain or sub-domain
MALLLPLVWIFQRHLKLDAIDDEDKRT

SEQ ID NO: 27354 - protein, 28 aa, artificial
  peptide fold or domain or sub-domain
MLSSTTTLHLRPRPPPVTDDHPGKFYIP

SEQ ID NO: 27355 - protein, 24 aa, artificial
  peptide fold or domain or sub-domain
MAEYAGALQWAHIVDELAESVDRT

SEQ ID NO: 27356 - protein, 20 aa, artificial
  peptide fold or domain or sub-domain
RNAHNFPLDLTVVEAPSING

SEQ ID NO: 27357 - protein, 16 aa, artificial
  peptide fold or domain or sub-domain
HNFPLDLAAIEAPTNV

SEQ ID NO: 27358 - protein, 27 aa, artificial
  peptide fold or domain or sub-domain
KKEILCGNCNGAGFLGGFMSTFDETSG

SEQ ID NO: 27359 - protein, 24 aa, artificial
  peptide fold or domain or sub-domain
MDGGEIFHKNAWCMTCTYAYISIV

SEQ ID NO: 27360 - protein, 26 aa, artificial
  peptide fold or domain or sub-domain
MKSSQASPFVCVRILIPPRTLRYSNG

SEQ ID NO: 27361 - protein, 21 aa, artificial
  peptide fold or domain or sub-domain
MPYLVLDDRDRVITVHSDSVP

SEQ ID NO: 27362 - protein, 28 aa, artificial
  peptide fold or domain or sub-domain
MSLPCVLETQWKIDTWTVLDLWTNLQKS

SEQ ID NO: 27363 - protein, 22 aa, artificial
  peptide fold or domain or sub-domain
CNKDSTVAERKAPSTIAVKAKK

SEQ ID NO: 27364 - protein, 29 aa, artificial
  peptide fold or domain or sub-domain
MEDSCSSVFHMLETHRSKTVVREEQNGQS

SEQ ID NO: 27365 - protein, 30 aa, artificial
  peptide fold or domain or sub-domain
MKEKEENAMKMIEGEMSFLVQQKRCKSIGR

SEQ ID NO: 27366 - protein, 30 aa, artificial
  peptide fold or domain or sub-domain
RVLWGQWAILKAVWGVTIGIRAGWFVRPSS

SEQ ID NO: 27367 - protein, 23 aa, artificial
  peptide fold or domain or sub-domain
PTGTVYDILRKAEFFKEKERTLS

SEQ ID NO: 27368 - protein, 28 aa, artificial
  peptide fold or domain or sub-domain
ASRRALIHRYPNGETHPFRVSLTEYIGV

SEQ ID NO: 27369 - protein, 25 aa, artificial
  peptide fold or domain or sub-domain
MRINPTTSGAGASVLEKKNLGRIVQ

SEQ ID NO: 27370 - protein, 30 aa, artificial
  peptide fold or domain or sub-domain
MALTLWARLAQQRNNPSAQKITKIDPAALY

SEQ ID NO: 27371 - protein, 30 aa, artificial
  peptide fold or domain or sub-domain
MTLVPHIDVEPTKHYRFLRSPHRQEYTPLD

SEQ ID NO: 27372 - protein, 28 aa, artificial
  peptide fold or domain or sub-domain
MLMEGSRIIFGPFNILLLRLTYGLTAKT

SEQ ID NO: 27373 - protein, 28 aa, artificial
  peptide fold or domain or sub-domain
MDQSKSETDADATQRGLQDLNEKLQGCW

SEQ ID NO: 27374 - protein, 25 aa, artificial
  peptide fold or domain or sub-domain
MGGRDHNGKDKKTKEEDANSWKTIA

SEQ ID NO: 27375 - protein, 27 aa, artificial
  peptide fold or domain or sub-domain
MARRDGHHTHGATDRDGSIGWDNTHIE

SEQ ID NO: 27376 - protein, 23 aa, artificial
  peptide fold or domain or sub-domain
MFLGATKKAIPSWYGGSVLNVAS

SEQ ID NO: 27377 - protein, 29 aa, artificial
  peptide fold or domain or sub-domain
MATGRRGARDDGNTTDAARGVGINNIIFS

SEQ ID NO: 27378 - protein, 28 aa, artificial
  peptide fold or domain or sub-domain
MASFLFSRGLFLPSPFPLRRGWAGLVVL

SEQ ID NO: 27379 - protein, 12 aa, artificial
  peptide fold or domain or sub-domain
FSFLVVWGRSGL

SEQ ID NO: 27380 - protein, 20 aa, artificial
  peptide fold or domain or sub-domain
MRSNCSWKLKYLFLAVELES

SEQ ID NO: 27381 - protein, 25 aa, artificial
  peptide fold or domain or sub-domain
MNSQKKQSGLQLQGVVCQCFSNGRF

SEQ ID NO: 27382 - protein, 16 aa, artificial
  peptide fold or domain or sub-domain
MSCREGLMSPQTETQA

SEQ ID NO: 27383 - protein, 16 aa, artificial
  peptide fold or domain or sub-domain
MSCREGLMSPQPETKA

SEQ ID NO: 27384 - protein, 29 aa, artificial
  peptide fold or domain or sub-domain
CGETCKVTKRCSGQGCSCLKGRSCYDFKK

SEQ ID NO: 27385 - protein, 30 aa, artificial
  peptide fold or domain or sub-domain
CAETCVVLPCFIVPGCSCKSSVCYFNSLDN

SEQ ID NO: 27386 - protein, 22 aa, artificial
  peptide fold or domain or sub-domain
MAEWLKHPTHNWRIQVIYLLYI

SEQ ID NO: 27387 - protein, 23 aa, artificial
  peptide fold or domain or sub-domain
MAIRLYRLIRQARVTDLYLNLMK

SEQ ID NO: 27388 - protein, 29 aa, artificial
  peptide fold or domain or sub-domain
EFNNRHLLAFQPSFYFQGLFERESSTSWS

SEQ ID NO: 27389 - protein, 25 aa, artificial
  peptide fold or domain or sub-domain
SYPLQRNFHLFSISIKEFLCVSAPP

SEQ ID NO: 27390 - protein, 25 aa, artificial
  peptide fold or domain or sub-domain
MRTNPTTSRPGDPLESTCSPSLALA

SEQ ID NO: 27391 - protein, 27 aa, artificial
  peptide fold or domain or sub-domain
MASPVPPKAWVVNDMVINYTISLWSFM

SEQ ID NO: 27392 - protein, 30 aa, artificial
  peptide fold or domain or sub-domain
MALVARTASEQIDADCSALVAGSGSKIKIL

SEQ ID NO: 27393 - protein, 30 aa, artificial
  peptide fold or domain or sub-domain
MANDNLDYEFTGGRTNIWTPYGEEEEEDFD

SEQ ID NO: 27394 - protein, 30 aa, artificial
  peptide fold or domain or sub-domain
MAKKAMKKARNGVDHGTEELLVFSVLRKFN

SEQ ID NO: 27395 - protein, 27 aa, artificial
  peptide fold or domain or sub-domain
MVINHQSWERMSIKNGNIFYVDGLTWF

SEQ ID NO: 27396 - protein, 26 aa, artificial
  peptide fold or domain or sub-domain
RITDEEVHQVCISKRRAGLFKKANEL

SEQ ID NO: 27397 - protein, 19 aa, artificial
  peptide fold or domain or sub-domain
RKNTAHVQETEERETNVNS

SEQ ID NO: 27398 - protein, 25 aa, artificial
  peptide fold or domain or sub-domain
EFQPKRIGEGDQGTGGDLYATVFEN

SEQ ID NO: 27399 - protein, 22 aa, artificial
  peptide fold or domain or sub-domain
MKIREVLILLLIISMELRCWEG

SEQ ID NO: 27400 - protein, 21 aa, artificial
  peptide fold or domain or sub-domain
MFTPCTHLTGLDYDDFLNRSG

SEQ ID NO: 27401 - protein, 24 aa, artificial
  peptide fold or domain or sub-domain
MGNSLEEGPCMQHSMMRRYSARTS

SEQ ID NO: 27402 - protein, 21 aa, artificial
  peptide fold or domain or sub-domain
MIYLSQVSKSVQRHPFHLVDP

SEQ ID NO: 27403 - protein, 28 aa, artificial
  peptide fold or domain or sub-domain
MTFGILMRRIRILHSFSVVFLYWFYVFS

SEQ ID NO: 27404 - protein, 28 aa, artificial
  peptide fold or domain or sub-domain
RTADYYPKSLLSFPRTTSEPSLTPLTGH

SEQ ID NO: 27405 - protein, 21 aa, artificial
  peptide fold or domain or sub-domain
GRRIITQKASSHFQGPRASLL

SEQ ID NO: 27406 - protein, 15 aa, artificial
  peptide fold or domain or sub-domain
VYDWLYSGDSRIKHR

SEQ ID NO: 27407 - protein, 13 aa, artificial
  peptide fold or domain or sub-domain
MATTKSFLILTVM

SEQ ID NO: 27408 - protein, 30 aa, artificial
  peptide fold or domain or sub-domain
MITDSQIFFALCIALTAAVLAIGLGRQLYV

SEQ ID NO: 27409 - protein, 12 aa, artificial
  peptide fold or domain or sub-domain
MAFLTQISKSIQ

SEQ ID NO: 27410 - protein, 28 aa, artificial
  peptide fold or domain or sub-domain
MKTDSRTFGTSTLVAKTIGRITQIIGPV

SEQ ID NO: 27411 - protein, 16 aa, artificial
  peptide fold or domain or sub-domain
NFPLDLAAIQAPSING

SEQ ID NO: 27412 - protein, 16 aa, artificial
  peptide fold or domain or sub-domain
NFPLDLAAVEAPYTNG

SEQ ID NO: 27413 - protein, 16 aa, artificial
  peptide fold or domain or sub-domain
NFPLDLAAIQVPSTNG

SEQ ID NO: 27414 - protein, 16 aa, artificial
  peptide fold or domain or sub-domain
NFPLDLAAVEGPSTNG

SEQ ID NO: 27415 - protein, 16 aa, artificial
  peptide fold or domain or sub-domain
NFPLDLAAVETPSTNG

SEQ ID NO: 27416 - protein, 28 aa, artificial
  peptide fold or domain or sub-domain
MRTNLLLLGASTLIVKNVGSITQYWSRV

SEQ ID NO: 27417 - protein, 26 aa, artificial
  peptide fold or domain or sub-domain
LTGKGTFQTSTHSYELLYAENIYEII

SEQ ID NO: 27418 - protein, 22 aa, artificial
  peptide fold or domain or sub-domain
MSWNQSDGAGESKIVAQRGHAV

SEQ ID NO: 27419 - protein, 30 aa, artificial
  peptide fold or domain or sub-domain
MGLRLTAAVACGAAPSGGRRFFFDLGMICD

SEQ ID NO: 27420 - protein, 30 aa, artificial
  peptide fold or domain or sub-domain
MFDETIDGDSFTGIGARTARMKSVRFRVLI

SEQ ID NO: 27421 - protein, 27 aa, artificial
  peptide fold or domain or sub-domain
LSFIKYLVFFCGYFVSIKESKNKRVRF

SEQ ID NO: 27422 - protein, 28 aa, artificial
  peptide fold or domain or sub-domain
MYHYCWSKTFGWISLMPLSTLKRDLCLL

SEQ ID NO: 27423 - protein, 24 aa, artificial
  peptide fold or domain or sub-domain
MAFLISLYCSSILLNTFVNYYIDT

SEQ ID NO: 27424 - protein, 25 aa, artificial
  peptide fold or domain or sub-domain
MVSLAESQHNACVKYKPLNSATTKQ

SEQ ID NO: 27425 - protein, 29 aa, artificial
  peptide fold or domain or sub-domain
MKPKYIYRHKKDKKLEETISHKTHQDETH

SEQ ID NO: 27426 - protein, 25 aa, artificial
  peptide fold or domain or sub-domain
MVFFSPPFLINSPSGVVDGSIANTP

SEQ ID NO: 27427 - protein, 25 aa, artificial
  peptide fold or domain or sub-domain
HLLHEVHRFLMAKIYRPILDRLVSI

SEQ ID NO: 27428 - protein, 21 aa, artificial
  peptide fold or domain or sub-domain
FAQVNHTESASFDFLVLFCND

SEQ ID NO: 27429 - protein, 30 aa, artificial
  peptide fold or domain or sub-domain
MFCNGRIDLTQKKKKEKNSLSGEHLDIICQ

SEQ ID NO: 27430 - protein, 24 aa, artificial
  peptide fold or domain or sub-domain
MKPCTQGSTSIRLCLVYSDCIFVV

SEQ ID NO: 27431 - protein, 19 aa, artificial
  peptide fold or domain or sub-domain
MVLGIMYDDVMISKHVRIF

SEQ ID NO: 27432 - protein, 21 aa, artificial
  peptide fold or domain or sub-domain
ELESSKLYPQMNQKTILVSLL

SEQ ID NO: 27433 - protein, 29 aa, artificial
  peptide fold or domain or sub-domain
MKPAEKMQTKPFKEETEEPQFGKSPQQFV

SEQ ID NO: 27434 - protein, 19 aa, artificial
  peptide fold or domain or sub-domain
LTADCSMGSPEPGMQRFFS

SEQ ID NO: 27435 - protein, 21 aa, artificial
  peptide fold or domain or sub-domain
MYKLVVILGHKFNYVANTLFA

SEQ ID NO: 27436 - protein, 28 aa, artificial
  peptide fold or domain or sub-domain
MYSPAFRRVFLLSALVLRSSINEIYISS

SEQ ID NO: 27437 - protein, 23 aa, artificial
  peptide fold or domain or sub-domain
MFEAQLLHLSKIATKHMRFIYIL

SEQ ID NO: 27438 - protein, 28 aa, artificial
  peptide fold or domain or sub-domain
ERARSTIIGCVHKLRRKSLVGIKVEEEA

SEQ ID NO: 27439 - protein, 23 aa, artificial
  peptide fold or domain or sub-domain
MRVSAAVYSSSNSAAMATVIMMI

SEQ ID NO: 27440 - protein, 19 aa, artificial
  peptide fold or domain or sub-domain
SAVLVSPEKKGFLVLQGTL

SEQ ID NO: 27441 - protein, 25 aa, artificial
  peptide fold or domain or sub-domain
MFTRSIRFAFFFRRILLSPNSSFPL

SEQ ID NO: 27442 - protein, 24 aa, artificial
  peptide fold or domain or sub-domain
MFLNSLIGVPSTVKMILCGFQRIV

SEQ ID NO: 27443 - protein, 29 aa, artificial
  peptide fold or domain or sub-domain
MLRSPPRGFVVPSSGQQHVVWTTCTGIAT

SEQ ID NO: 27444 - protein, 12 aa, artificial
  peptide fold or domain or sub-domain
EGGRCYSFTDVT

SEQ ID NO: 27445 - protein, 25 aa, artificial
  peptide fold or domain or sub-domain
TVLICVGPRNSSGGPGIILTETRGG

SEQ ID NO: 27446 - protein, 23 aa, artificial
  peptide fold or domain or sub-domain
MTTSALSFEISELVENNVGYITQ

SEQ ID NO: 27447 - protein, 25 aa, artificial
  peptide fold or domain or sub-domain
MAAAISVFSSGYSFYKNLLLDSKPN

SEQ ID NO: 27448 - protein, 27 aa, artificial
  peptide fold or domain or sub-domain
MARAGGERRRVQKGPLYIRLCQAAEHL

SEQ ID NO: 27449 - protein, 30 aa, artificial
  peptide fold or domain or sub-domain
MAMKLKLPKFYGHPLNFLKLMEISDQIRWL

SEQ ID NO: 27450 - protein, 25 aa, artificial
  peptide fold or domain or sub-domain
RSLIEARGREAALDLFRTPRRYSYI

SEQ ID NO: 27451 - protein, 17 aa, artificial
  peptide fold or domain or sub-domain
LCLVTRFRKQHIGRMKG

SEQ ID NO: 27452 - protein, 30 aa, artificial
  peptide fold or domain or sub-domain
LNHIILGVAIIKKHNFRACNYFENWMPCLL

SEQ ID NO: 27453 - protein, 23 aa, artificial
  peptide fold or domain or sub-domain
MATKTAESSLKSGPRRTGVGSLL

SEQ ID NO: 27454 - protein, 29 aa, artificial
  peptide fold or domain or sub-domain
LAQCSPGGPSLKNNKKYAPTEATQATSHQ

SEQ ID NO: 27455 - protein, 25 aa, artificial
  peptide fold or domain or sub-domain
ADMLTKPLPPAKFDHCLNLASIIHT

SEQ ID NO: 27456 - protein, 29 aa, artificial
  peptide fold or domain or sub-domain
ADMFTNSLPRERVFFLRNELDILDFQNIS

SEQ ID NO: 27457 - protein, 25 aa, artificial
  peptide fold or domain or sub-domain
MECCGPYRGDHDSSGVYRGANNSFW

SEQ ID NO: 27458 - protein, 30 aa, artificial
  peptide fold or domain or sub-domain
MDGFSRHPSFVKFLVVSLWIFLLLRCLLCV

SEQ ID NO: 27459 - protein, 24 aa, artificial
  peptide fold or domain or sub-domain
MRCAFVHGGGCTSCRGTDLWSGSV

SEQ ID NO: 27460 - protein, 28 aa, artificial
  peptide fold or domain or sub-domain
MVSWLKPAAFTIAVHLRSSSEEWRLSIV

SEQ ID NO: 27461 - protein, 26 aa, artificial
  peptide fold or domain or sub-domain
PGGTGLRVGRLASVSDDKSISLYDYS

SEQ ID NO: 27462 - protein, 30 aa, artificial
  peptide fold or domain or sub-domain
MSPAAATETAIESTGAPKRAFVTFLAGNGT

SEQ ID NO: 27463 - protein, 21 aa, artificial
  peptide fold or domain or sub-domain
QNLSASPQNGHCCWRAVPKLA

SEQ ID NO: 27464 - protein, 25 aa, artificial
  peptide fold or domain or sub-domain
MAMIGLSLNTGIDILSSSSNSLAFN

SEQ ID NO: 27465 - protein, 28 aa, artificial
  peptide fold or domain or sub-domain
LLLLDDVWEPRGMGMRAQNTLGECKCFR

SEQ ID NO: 27466 - protein, 30 aa, artificial
  peptide fold or domain or sub-domain
STVSISLISNSRDGCKCGDNCTCNPCNCGK

SEQ ID NO: 27467 - protein, 25 aa, artificial
  peptide fold or domain or sub-domain
ANNIMSFIFKTVTPKNHLNVLSFAV

SEQ ID NO: 27468 - protein, 17 aa, artificial
  peptide fold or domain or sub-domain
ANNILKFFTKSPVVAFA

SEQ ID NO: 27469 - protein, 14 aa, artificial
  peptide fold or domain or sub-domain
ANNIVPFSRKVALV

SEQ ID NO: 27470 - protein, 14 aa, artificial
  peptide fold or domain or sub-domain
ANNILSFNTKLALA

SEQ ID NO: 27471 - protein, 15 aa, artificial
  peptide fold or domain or sub-domain
AKHQIVPFSKRIIVV

SEQ ID NO: 27472 - protein, 23 aa, artificial
  peptide fold or domain or sub-domain
ATIITWFISKIINRNACSLQFVV

SEQ ID NO: 27473 - protein, 28 aa, artificial
  peptide fold or domain or sub-domain
MAETWGRKRVGRKQGIRNSFKGLITPKI

SEQ ID NO: 27474 - protein, 28 aa, artificial
  peptide fold or domain or sub-domain
LKTSTFFILILPNAAAITTYLTLHKHPY

SEQ ID NO: 27475 - protein, 28 aa, artificial
  peptide fold or domain or sub-domain
RCTARQPGTSLRHHVALNCNCEKEESDA

SEQ ID NO: 27476 - protein, 29 aa, artificial
  peptide fold or domain or sub-domain
VQQAVAAAFKNNSGVAAGLIRLHFHDCFV

SEQ ID NO: 27477 - protein, 12 aa, artificial
  peptide fold or domain or sub-domain
ATGKVVQGAMPP

SEQ ID NO: 27478 - protein, 13 aa, artificial
  peptide fold or domain or sub-domain
YPPFFDDWRSGYI

SEQ ID NO: 27479 - protein, 30 aa, artificial
  peptide fold or domain or sub-domain
YISPVSAVAATASPLFWPQATSIAATHPFV

SEQ ID NO: 27480 - protein, 14 aa, artificial
  peptide fold or domain or sub-domain
ALESAKLGPWWIGP

SEQ ID NO: 27481 - protein, 14 aa, artificial
  peptide fold or domain or sub-domain
ALESAKLVPWWIPP

SEQ ID NO: 27482 - protein, 13 aa, artificial
  peptide fold or domain or sub-domain
TADMDGPGNPEMT

SEQ ID NO: 27483 - protein, 19 aa, artificial
  peptide fold or domain or sub-domain
DSDKVMLAKQTGLSRNQVS

SEQ ID NO: 27484 - protein, 17 aa, artificial
  peptide fold or domain or sub-domain
KTISFNFNQFDQNEEQL

SEQ ID NO: 27485 - protein, 29 aa, artificial
  peptide fold or domain or sub-domain
IDTVKWTLEFGQDSKHYTTMLTSLRDKVK

SEQ ID NO: 27486 - protein, 30 aa, artificial
  peptide fold or domain or sub-domain
TMLKYKIAVFVQKANDIEAKLNYNKIDGSD

SEQ ID NO: 27487 - protein, 27 aa, artificial
  peptide fold or domain or sub-domain
FIFPQCSQAPIAILLQFYLPVAVMGFQ

SEQ ID NO: 27488 - protein, 11 aa, artificial
  peptide fold or domain or sub-domain
ATVVWPKYELL

SEQ ID NO: 27489 - protein, 12 aa, artificial
  peptide fold or domain or sub-domain
AGVVKFFYGEAE

SEQ ID NO: 27490 - protein, 15 aa, artificial
  peptide fold or domain or sub-domain
VGIVALPILPYDYGA

SEQ ID NO: 27491 - protein, 14 aa, artificial
  peptide fold or domain or sub-domain
AVTFTDDHTANGIK

SEQ ID NO: 27492 - protein, 22 aa, artificial
  peptide fold or domain or sub-domain
GPKFVVGGNLKKLGSKDTVDKI

SEQ ID NO: 27493 - protein, 14 aa, artificial
  peptide fold or domain or sub-domain
SRQLSPIGKELQTP

SEQ ID NO: 27494 - protein, 16 aa, artificial
  peptide fold or domain or sub-domain
AITANVIVANDGSKTY

SEQ ID NO: 27495 - protein, 16 aa, artificial
  peptide fold or domain or sub-domain
YIITFAATDAGKKNIY

SEQ ID NO: 27496 - protein, 15 aa, artificial
  peptide fold or domain or sub-domain
STVLEGLKYANCHEW

SEQ ID NO: 27497 - protein, 23 aa, artificial
  peptide fold or domain or sub-domain
SPGEWCWPGMGHPMYPFPRCRAL

SEQ ID NO: 27498 - protein, 30 aa, artificial
  peptide fold or domain or sub-domain
AGGVDDAPLVGNKAPDFFAEEVFFQQFINV

SEQ ID NO: 27499 - protein, 14 aa, artificial
  peptide fold or domain or sub-domain
YDYFQFTQQYWPAV

SEQ ID NO: 27500 - protein, 20 aa, artificial
  peptide fold or domain or sub-domain
ELYASSCHHEETQIFQYPAV

SEQ ID NO: 27501 - protein, 16 aa, artificial
  peptide fold or domain or sub-domain
PGLVIGDIVPNPEGDS

SEQ ID NO: 27502 - protein, 15 aa, artificial
  peptide fold or domain or sub-domain
AYQDIPDRKDALIGI

SEQ ID NO: 27503 - protein, 15 aa, artificial
  peptide fold or domain or sub-domain
YTITNLADTYRGPFY

SEQ ID NO: 27504 - protein, 15 aa, artificial
  peptide fold or domain or sub-domain
YYTDETHRTGSLDDG

SEQ ID NO: 27505 - protein, 15 aa, artificial
  peptide fold or domain or sub-domain
VSTIATGVGHLVRTG

SEQ ID NO: 27506 - protein, 13 aa, artificial
  peptide fold or domain or sub-domain
RLYEYANNRVKAT

SEQ ID NO: 27507 - protein, 28 aa, artificial
  peptide fold or domain or sub-domain
MAMMTGAQRRDDGNHEDDGDHEPQRQMV

SEQ ID NO: 27508 - protein, 30 aa, artificial
  peptide fold or domain or sub-domain
MATIYSWVHTGLPTKCRSREAINTCPSSVL

SEQ ID NO: 27509 - protein, 15 aa, artificial
  peptide fold or domain or sub-domain
MAKDRMPERVFNSEP

SEQ ID NO: 27510 - protein, 28 aa, artificial
  peptide fold or domain or sub-domain
MGRRHGTTRAVSASLRMELEGKIFMNLS

SEQ ID NO: 27511 - protein, 19 aa, artificial
  peptide fold or domain or sub-domain
NGHNFPLDLAAVEAPAING

SEQ ID NO: 27512 - protein, 12 aa, artificial
  peptide fold or domain or sub-domain
KIGDPTTRRQEV

SEQ ID NO: 27513 - protein, 21 aa, artificial
  peptide fold or domain or sub-domain
VRNHQVIFSKCRNGLLTMYDF

SEQ ID NO: 27514 - protein, 30 aa, artificial
  peptide fold or domain or sub-domain
KRIQNPARRQITFSKRKSGLLKKACELSVL

SEQ ID NO: 27515 - protein, 15 aa, artificial
  peptide fold or domain or sub-domain
MTIFNNLPSIFVPLG

SEQ ID NO: 27516 - protein, 19 aa, artificial
  peptide fold or domain or sub-domain
MPVAFSRLSHWHLTFCLSR

SEQ ID NO: 27517 - protein, 12 aa, artificial
  peptide fold or domain or sub-domain
MEDAWLEHLHSS

SEQ ID NO: 27518 - protein, 21 aa, artificial
  peptide fold or domain or sub-domain
MGVGSQTMWSILLLLSCIFSA

SEQ ID NO: 27519 - protein, 30 aa, artificial
  peptide fold or domain or sub-domain
KMNERLRNYEAELKRKREEKLNEFQESPKF

SEQ ID NO: 27520 - protein, 19 aa, artificial
  peptide fold or domain or sub-domain
MKSFTSTRSCYRSADLLRL

SEQ ID NO: 27521 - protein, 30 aa, artificial
  peptide fold or domain or sub-domain
MAVGKNLATSSLRSQDEASFTIISLIFLRI

SEQ ID NO: 27522 - protein, 27 aa, artificial
  peptide fold or domain or sub-domain
LGWDGNVARHNAGVAMGAPVVEGGMRR

SEQ ID NO: 27523 - protein, 26 aa, artificial
  peptide fold or domain or sub-domain
PVSDATTLFVPTAFASLIALAFGFLF

SEQ ID NO: 27524 - protein, 28 aa, artificial
  peptide fold or domain or sub-domain
FTAVSKGLIIDPLLECVEGWNGAPLPIC

SEQ ID NO: 27525 - protein, 25 aa, artificial
  peptide fold or domain or sub-domain
MLVIEQDLKPIKKFILLVIILWLVQ

SEQ ID NO: 27526 - protein, 18 aa, artificial
  peptide fold or domain or sub-domain
THYRAYIYANAWAIEFIK

SEQ ID NO: 27527 - protein, 30 aa, artificial
  peptide fold or domain or sub-domain
IDPAIALSLPKRCQFSDRPVGYKCGAYTVP

SEQ ID NO: 27528 - protein, 27 aa, artificial
  peptide fold or domain or sub-domain
MVPTITSRKVTHPETTPVQARLTVEFS

SEQ ID NO: 27529 - protein, 24 aa, artificial
  peptide fold or domain or sub-domain
MTSPVFLHSDDPYSFFVFYSLYSQ

SEQ ID NO: 27530 - protein, 20 aa, artificial
  peptide fold or domain or sub-domain
MATRNLEKLASIDAQLRALV

SEQ ID NO: 27531 - protein, 19 aa, artificial
  peptide fold or domain or sub-domain
MRKNTTTSDPKFSAFQKEN

SEQ ID NO: 27532 - protein, 18 aa, artificial
  peptide fold or domain or sub-domain
CSQLPLDLASVEVPSING

SEQ ID NO: 27533 - protein, 15 aa, artificial
  peptide fold or domain or sub-domain
NFPLDASVEVPSING

SEQ ID NO: 27534 - protein, 25 aa, artificial
  peptide fold or domain or sub-domain
MYRPLVARLLQDSVATRKGPSHFAR

SEQ ID NO: 27535 - protein, 21 aa, artificial
  peptide fold or domain or sub-domain
SSRKDPSTPRWFDPNRSNRYP

SEQ ID NO: 27536 - protein, 12 aa, artificial
  peptide fold or domain or sub-domain
MYAHAVHCLIYD

SEQ ID NO: 27537 - protein, 22 aa, artificial
  peptide fold or domain or sub-domain
MAYVVFVGWSLLLVAPLDPVMF

SEQ ID NO: 27538 - protein, 25 aa, artificial
  peptide fold or domain or sub-domain
MLRHMEEYSKPALNRSTWPTKTKVG

SEQ ID NO: 27539 - protein, 27 aa, artificial
  peptide fold or domain or sub-domain
MFGFFSGNGKNISTITVLFFFREVYGV

SEQ ID NO: 27540 - protein, 16 aa, artificial
  peptide fold or domain or sub-domain
MEEVFPSNSKSKAGQM

SEQ ID NO: 27541 - protein, 27 aa, artificial
  peptide fold or domain or sub-domain
MENRQVVKVDKHAPYLSAVPIQQQHHI

SEQ ID NO: 27542 - protein, 15 aa, artificial
  peptide fold or domain or sub-domain
MVTCKLHARARIIFF

SEQ ID NO: 27543 - protein, 25 aa, artificial
  peptide fold or domain or sub-domain
INGIGERSGNAPLEEVVMALKCRGN

SEQ ID NO: 27544 - protein, 30 aa, artificial
  peptide fold or domain or sub-domain
MKSFNTEGHNHSTAESGCYTCRPAKERDEE

SEQ ID NO: 27545 - protein, 18 aa, artificial
  peptide fold or domain or sub-domain
MEGVHKGPRYSDDPDSVQ

SEQ ID NO: 27546 - protein, 24 aa, artificial
  peptide fold or domain or sub-domain
MLSTIDWDQFYLYVPNRENIINLK

SEQ ID NO: 27547 - protein, 17 aa, artificial
  peptide fold or domain or sub-domain
MVMSTTSLSLDEIRKAQ

SEQ ID NO: 27548 - protein, 17 aa, artificial
  peptide fold or domain or sub-domain
MVMGARSLDLDEIRKAQ

SEQ ID NO: 27549 - protein, 17 aa, artificial
  peptide fold or domain or sub-domain
MVMAAGASSSDEIRKAQ

SEQ ID NO: 27550 - protein, 30 aa, artificial
  peptide fold or domain or sub-domain
MGYILLKILVWYHRALESWVGTPQGIRELV

SEQ ID NO: 27551 - protein, 21 aa, artificial
  peptide fold or domain or sub-domain
TPFTDVTFSWLVYRWTISARP

SEQ ID NO: 27552 - protein, 15 aa, artificial
  peptide fold or domain or sub-domain
TPFTDVIVDNISKAL

SEQ ID NO: 27553 - protein, 14 aa, artificial
  peptide fold or domain or sub-domain
MESYDKVGSNKMPS

SEQ ID NO: 27554 - protein, 19 aa, artificial
  peptide fold or domain or sub-domain
MLSSKQHMVLHLNTQIKMS

SEQ ID NO: 27555 - protein, 17 aa, artificial
  peptide fold or domain or sub-domain
MQQMPLKKQLKMLVKSS

SEQ ID NO: 27556 - protein, 20 aa, artificial
  peptide fold or domain or sub-domain
RLRNRKNQLTHESISDLQKR

SEQ ID NO: 27557 - protein, 28 aa, artificial
  peptide fold or domain or sub-domain
MFTYRLMVHNTYFLLLKQNNMSRSMIIV

SEQ ID NO: 27558 - protein, 17 aa, artificial
  peptide fold or domain or sub-domain
MDAHYKAHHLSPSSRCF

SEQ ID NO: 27559 - protein, 28 aa, artificial
  peptide fold or domain or sub-domain
MSVKAKAMRRIETEFKAMSSKASLYSIG

SEQ ID NO: 27560 - protein, 26 aa, artificial
  peptide fold or domain or sub-domain
ALQYTTCPINSPCKGVQVIKLSKEEE

SEQ ID NO: 27561 - protein, 29 aa, artificial
  peptide fold or domain or sub-domain
ADILTKGVLGNVFRRLRAMIMVNSLDTMN

SEQ ID NO: 27562 - protein, 22 aa, artificial
  peptide fold or domain or sub-domain
DERNAHNFPLDLAAIEAPSTNG

SEQ ID NO: 27563 - protein, 25 aa, artificial
  peptide fold or domain or sub-domain
PAPKKGGIVQRSGPAGEQPPECKQQ

SEQ ID NO: 27564 - protein, 19 aa, artificial
  peptide fold or domain or sub-domain
EAGKIFDFNTLPVMAGEEL

SEQ ID NO: 27565 - protein, 20 aa, artificial
  peptide fold or domain or sub-domain
GIFTFEDESTSIVAPARLYK

SEQ ID NO: 27566 - protein, 18 aa, artificial
  peptide fold or domain or sub-domain
KNFEETVGIGKGVDKLYA

SEQ ID NO: 27567 - protein, 15 aa, artificial
  peptide fold or domain or sub-domain
SRVNQSKNDIIVSPR

SEQ ID NO: 27568 - protein, 15 aa, artificial
  peptide fold or domain or sub-domain
NSGSAIVATDNQNTY

SEQ ID NO: 27569 - protein, 23 aa, artificial
  peptide fold or domain or sub-domain
LPDAIDRRQIGAVTEVDDQAADG

SEQ ID NO: 27570 - protein, 19 aa, artificial
  peptide fold or domain or sub-domain
LGADKYPDRQPLGTSVQTR

SEQ ID NO: 27571 - protein, 20 aa, artificial
  peptide fold or domain or sub-domain
ERDYGEYCRVGKSIPINPLP

SEQ ID NO: 27572 - protein, 26 aa, artificial
  peptide fold or domain or sub-domain
ADIPAGLVTGGQIAAALPYGNTLVVK

SEQ ID NO: 27573 - protein, 26 aa, artificial
  peptide fold or domain or sub-domain
SALENSVEGNIAGGEALGQFAQVGGF

SEQ ID NO: 27574 - protein, 21 aa, artificial
  peptide fold or domain or sub-domain
IAHLENDLNVVWPNVVTGNNK

SEQ ID NO: 27575 - protein, 29 aa, artificial
  peptide fold or domain or sub-domain
LTTSYGTVGTTPGPWLSAWLSAPQLIVTN

SEQ ID NO: 27576 - protein, 18 aa, artificial
  peptide fold or domain or sub-domain
ACGRVFNFEAGPAMLPLE

SEQ ID NO: 27577 - protein, 30 aa, artificial
  peptide fold or domain or sub-domain
AAVPENVKEASEWDIYWKSKQGGAKFDAGL

SEQ ID NO: 27578 - protein, 27 aa, artificial
  peptide fold or domain or sub-domain
VPQLDCLSWRLAVETNNLQNSKLVPPE

SEQ ID NO: 27579 - protein, 27 aa, artificial
  peptide fold or domain or sub-domain
LNCGQVDTLVKPCLPFARGGPGPSAEE

SEQ ID NO: 27580 - protein, 19 aa, artificial
  peptide fold or domain or sub-domain
MTVGQVQGNLAQPSGFLQN

SEQ ID NO: 27581 - protein, 19 aa, artificial
  peptide fold or domain or sub-domain
EETRGLGTVEGEDLVTGYA

SEQ ID NO: 27582 - protein, 29 aa, artificial
  peptide fold or domain or sub-domain
ADILTKPLVKGKFVYFRDKLGGCAEHLPR

SEQ ID NO: 27583 - protein, 30 aa, artificial
  peptide fold or domain or sub-domain
MQRKEAFHSLALSTSKNLLVSCYTNKLMEP

SEQ ID NO: 27584 - protein, 26 aa, artificial
  peptide fold or domain or sub-domain
MMTPYKRLGGGANTVADGQHRNSSWC

SEQ ID NO: 27585 - protein, 16 aa, artificial
  peptide fold or domain or sub-domain
MASQAVETLYSPPFAL

SEQ ID NO: 27586 - protein, 22 aa, artificial
  peptide fold or domain or sub-domain
MNNKCPQNKKKKSERNFFSLSI

SEQ ID NO: 27587 - protein, 18 aa, artificial
  peptide fold or domain or sub-domain
ELKSADGSKAFDPVEHMR

SEQ ID NO: 27588 - protein, 17 aa, artificial
  peptide fold or domain or sub-domain
VAQGSVVAIDDEEKAVI

SEQ ID NO: 27589 - protein, 14 aa, artificial
  peptide fold or domain or sub-domain
MFPAHTEFKNYGQQ

SEQ ID NO: 27590 - protein, 30 aa, artificial
  peptide fold or domain or sub-domain
VMHERNAHNFPLDHLAWKFHLQMDKTLVLV

SEQ ID NO: 27591 - protein, 29 aa, artificial
  peptide fold or domain or sub-domain
VMHERNGHNFPLRPSCCRSSIYKWIRLWS

SEQ ID NO: 27592 - protein, 28 aa, artificial
  peptide fold or domain or sub-domain
MFFKYLNKYKRLTKLVELDLIQAICQAY

SEQ ID NO: 27593 - protein, 26 aa, artificial
  peptide fold or domain or sub-domain
MFVMITITCQLSIDLINPEFHANEAR

SEQ ID NO: 27594 - protein, 19 aa, artificial
  peptide fold or domain or sub-domain
VFFFKRRNPKTRSSRIYSH

SEQ ID NO: 27595 - protein, 28 aa, artificial
  peptide fold or domain or sub-domain
ADMLTKPLAKDAFFKIRRELGILDNKIF

SEQ ID NO: 27596 - protein, 22 aa, artificial
  peptide fold or domain or sub-domain
MDAKTFTCTAIAAVSVGVTVGL

SEQ ID NO: 27597 - protein, 28 aa, artificial
  peptide fold or domain or sub-domain
MRITQGAFSFLPDLTDDQTLKASRICDV

SEQ ID NO: 27598 - protein, 27 aa, artificial
  peptide fold or domain or sub-domain
MLIFVVVISTGWYNEYNAWTSYKTLFL

SEQ ID NO: 27599 - protein, 30 aa, artificial
  peptide fold or domain or sub-domain
MLLWNGGFFPSYEERFDTWLVVGVVNISVK

SEQ ID NO: 27600 - protein, 28 aa, artificial
  peptide fold or domain or sub-domain
EPFIESLQSMFDLEEREEIFGKWVFMIQ

SEQ ID NO: 27601 - protein, 23 aa, artificial
  peptide fold or domain or sub-domain
MPIGNRTAMRMLKPEAETRGQED

SEQ ID NO: 27602 - protein, 26 aa, artificial
  peptide fold or domain or sub-domain
MACSDFVLQEVEIVMYKHILQRNKTL

SEQ ID NO: 27603 - protein, 25 aa, artificial
  peptide fold or domain or sub-domain
MATQTVEDSSRARPRQTGIGNLLKP

SEQ ID NO: 27604 - protein, 27 aa, artificial
  peptide fold or domain or sub-domain
MVSKEQLILGTANAGNVKIEEGYKHEK

SEQ ID NO: 27605 - protein, 27 aa, artificial
  peptide fold or domain or sub-domain
MAASGVKRPPRPAPASSGGFVILPLLF

SEQ ID NO: 27606 - protein, 14 aa, artificial
  peptide fold or domain or sub-domain
MGVTKKPDLNDPYK

SEQ ID NO: 27607 - protein, 22 aa, artificial
  peptide fold or domain or sub-domain
ISRAVRGENFPIRFPGGVLFHL

SEQ ID NO: 27608 - protein, 14 aa, artificial
  peptide fold or domain or sub-domain
IPIRFQGGYCSSIS

SEQ ID NO: 27609 - protein, 14 aa, artificial
  peptide fold or domain or sub-domain
KLPIRFQGRYCSSR

SEQ ID NO: 27610 - protein, 30 aa, artificial
  peptide fold or domain or sub-domain
FYHVETLYNGKLTIGGRDQESTVLPGGPAM

SEQ ID NO: 27611 - protein, 29 aa, artificial
  peptide fold or domain or sub-domain
MVLNEVQTEVYYDKNGITSVMASEYRRLK

SEQ ID NO: 27612 - protein, 30 aa, artificial
  peptide fold or domain or sub-domain
MLVGARKNQPYPWNNRLAAGWRYYENERRR

SEQ ID NO: 27613 - protein, 26 aa, artificial
  peptide fold or domain or sub-domain
IIKSYHLEEGEVVTRFSVGEPAEGSS

SEQ ID NO: 27614 - protein, 24 aa, artificial
  peptide fold or domain or sub-domain
YHSPNDRKTHACGGNSNYQVVFCP

SEQ ID NO: 27615 - protein, 14 aa, artificial
  peptide fold or domain or sub-domain
MGVTKKPDLNDPIR

SEQ ID NO: 27616 - protein, 30 aa, artificial
  peptide fold or domain or sub-domain
SFFLEPYEEKTSLYGSGGDIVHLYLSQERQ

SEQ ID NO: 27617 - protein, 14 aa, artificial
  peptide fold or domain or sub-domain
LLYGSRGGIVDLYH

SEQ ID NO: 27618 - protein, 30 aa, artificial
  peptide fold or domain or sub-domain
WGGRRICKSVSPKIKEEANAQFLCLSYGFS

SEQ ID NO: 27619 - protein, 29 aa, artificial
  peptide fold or domain or sub-domain
GLIRCGFLYPPFSIGMKMLLNRHSLFCSC

SEQ ID NO: 27620 - protein, 29 aa, artificial
  peptide fold or domain or sub-domain
MAMKLTSKIELEIGREELRGYSLSHRLFH

SEQ ID NO: 27621 - protein, 27 aa, artificial
  peptide fold or domain or sub-domain
YFCLPIYHVSVNLVLAYRFSSIRCFSL

SEQ ID NO: 27622 - protein, 25 aa, artificial
  peptide fold or domain or sub-domain
MAGVGAVRIAGAATSSMAESEGYQR

SEQ ID NO: 27623 - protein, 25 aa, artificial
  peptide fold or domain or sub-domain
MATGRSLLWQLSPSVATFSPVNVVE

SEQ ID NO: 27624 - protein, 28 aa, artificial
  peptide fold or domain or sub-domain
MAIIHYQPKCQTQYNMAVGFQPHSRNDK

SEQ ID NO: 27625 - protein, 30 aa, artificial
  peptide fold or domain or sub-domain
MWRKNGGWSHACGGLESIARQLGCKRSDQT

SEQ ID NO: 27626 - protein, 22 aa, artificial
  peptide fold or domain or sub-domain
MKKAETEGGHPTCLEAISISEM

SEQ ID NO: 27627 - protein, 30 aa, artificial
  peptide fold or domain or sub-domain
MELILNKEYRLVIIVLISVYYRYRFFLLLF

SEQ ID NO: 27628 - protein, 25 aa, artificial
  peptide fold or domain or sub-domain
MADDNKKLNHDEEASPLLHHQQPKS

SEQ ID NO: 27629 - protein, 14 aa, artificial
  peptide fold or domain or sub-domain
VPGGVLFIYIYPNE

SEQ ID NO: 27630 - protein, 11 aa, artificial
  peptide fold or domain or sub-domain
SRGGIVHLYLS

SEQ ID NO: 27631 - protein, 29 aa, artificial
  peptide fold or domain or sub-domain
MDVYLPRTQGDVDDDGKERRTVIIGENLN

SEQ ID NO: 27632 - protein, 29 aa, artificial
  peptide fold or domain or sub-domain
MAWALRPSACLCLAMPSPERHLQAEDFGL

SEQ ID NO: 27633 - protein, 27 aa, artificial
  peptide fold or domain or sub-domain
MASQPLLFRWMQPHCKFIRSNPCFYIE

SEQ ID NO: 27634 - protein, 19 aa, artificial
  peptide fold or domain or sub-domain
MSNHCVSVSREATYAASRR

SEQ ID NO: 27635 - protein, 24 aa, artificial
  peptide fold or domain or sub-domain
ALLAERMRQTTHNRYKVGSTPIRC

SEQ ID NO: 27636 - protein, 25 aa, artificial
  peptide fold or domain or sub-domain
MAESEDIQPLVCDNGTGMVKVSINL

SEQ ID NO: 27637 - protein, 22 aa, artificial
  peptide fold or domain or sub-domain
RGTEKLIEYKTYLQALPYFDRL

SEQ ID NO: 27638 - protein, 12 aa, artificial
  peptide fold or domain or sub-domain
TSYTVPRGGIVD

SEQ ID NO: 27639 - protein, 19 aa, artificial
  peptide fold or domain or sub-domain
LPYTVPGGILFIYIYPNEP

SEQ ID NO: 27640 - protein, 22 aa, artificial
  peptide fold or domain or sub-domain
MEYLTTDRSIECGIYLKKIESI

SEQ ID NO: 27641 - protein, 27 aa, artificial
  peptide fold or domain or sub-domain
MLWGVLFQFMWAVVSLVVTALVACWAK

SEQ ID NO: 27642 - protein, 26 aa, artificial
  peptide fold or domain or sub-domain
PENTKKAFPVGAIFFFFNKISMSSTM

SEQ ID NO: 27643 - protein, 16 aa, artificial
  peptide fold or domain or sub-domain
FLDFACNNEACANVYK

SEQ ID NO: 27644 - protein, 29 aa, artificial
  peptide fold or domain or sub-domain
MGSYGFEPQWLENSAFSDEGESRPTGRLL

SEQ ID NO: 27645 - protein, 21 aa, artificial
  peptide fold or domain or sub-domain
MHIFYLNLFPQIFFKHRHQKY

SEQ ID NO: 27646 - protein, 15 aa, artificial
  peptide fold or domain or sub-domain
KVIPNNRIVPYDKAF

SEQ ID NO: 27647 - protein, 23 aa, artificial
  peptide fold or domain or sub-domain
QRQPWLQPLHQLSQGCLKPILYR

SEQ ID NO: 27648 - protein, 26 aa, artificial
  peptide fold or domain or sub-domain
PTTSSSLRCFITAISSRVFDPRFNST

SEQ ID NO: 27649 - protein, 17 aa, artificial
  peptide fold or domain or sub-domain
MRFYRPLGRICALTFDL

SEQ ID NO: 27650 - protein, 26 aa, artificial
  peptide fold or domain or sub-domain
MLNLLSPNQTWVLIDPRLSFYFPIIY

SEQ ID NO: 27651 - protein, 25 aa, artificial
  peptide fold or domain or sub-domain
MTCADDDAERSDEVGAPPACGGEWR

SEQ ID NO: 27652 - protein, 26 aa, artificial
  peptide fold or domain or sub-domain
AKKRLRRSPPADNCGDEAEAGSVCVL

SEQ ID NO: 27653 - protein, 18 aa, artificial
  peptide fold or domain or sub-domain
MFAPQIQNWWWTAHPAAH

SEQ ID NO: 27654 - protein, 18 aa, artificial
  peptide fold or domain or sub-domain
MNIPGSRSAESRSARPQV

SEQ ID NO: 27655 - protein, 13 aa, artificial
  peptide fold or domain or sub-domain
MNDCAILILDFGS

SEQ ID NO: 27656 - protein, 21 aa, artificial
  peptide fold or domain or sub-domain
MRELYIENPKFSVLIPVYNVE

SEQ ID NO: 27657 - protein, 13 aa, artificial
  peptide fold or domain or sub-domain
MNIRAILVLDFGS

SEQ ID NO: 27658 - protein, 13 aa, artificial
  peptide fold or domain or sub-domain
MNVCAILVLDFGS

SEQ ID NO: 27659 - protein, 25 aa, artificial
  peptide fold or domain or sub-domain
SLNLSNSVAIVVYEALRQLGYPGLE

SEQ ID NO: 27660 - protein, 19 aa, artificial
  peptide fold or domain or sub-domain
LTQEPIVKTLPKPVTLFIY

SEQ ID NO: 27661 - protein, 13 aa, artificial
  peptide fold or domain or sub-domain
MNARAILVLDFGS

SEQ ID NO: 27662 - protein, 20 aa, artificial
  peptide fold or domain or sub-domain
NNENQTKVSKSAFVPNMSLD

SEQ ID NO: 27663 - protein, 22 aa, artificial
  peptide fold or domain or sub-domain
MAHLRDKGVCAIQFTQVQHDPW

SEQ ID NO: 27664 - protein, 15 aa, artificial
  peptide fold or domain or sub-domain
MQGSVTEFLKPRLVD

SEQ ID NO: 27665 - protein, 20 aa, artificial
  peptide fold or domain or sub-domain
MSTLKKPNLSDPKLRAKLSN

SEQ ID NO: 27666 - protein, 25 aa, artificial
  peptide fold or domain or sub-domain
RVHDMSMTRNDSFLDNENGVDTSGH

SEQ ID NO: 27667 - protein, 28 aa, artificial
  peptide fold or domain or sub-domain
WHARAAQLARRPAHGRLEAGGHHDCGRP

SEQ ID NO: 27668 - protein, 22 aa, artificial
  peptide fold or domain or sub-domain
MADVIAKIVEIVKGLIDQFTQK

SEQ ID NO: 27669 - protein, 14 aa, artificial
  peptide fold or domain or sub-domain
KELPLDPTAGTDAA

SEQ ID NO: 27670 - protein, 13 aa, artificial
  peptide fold or domain or sub-domain
AERYLDGLADACK

SEQ ID NO: 27671 - protein, 23 aa, artificial
  peptide fold or domain or sub-domain
MKELKKPNILNIDNIARSRLFQI

SEQ ID NO: 27672 - protein, 25 aa, artificial
  peptide fold or domain or sub-domain
ALGIYNKHEIRSNLSPNGLNLTYKF

SEQ ID NO: 27673 - protein, 21 aa, artificial
  peptide fold or domain or sub-domain
MIDEKSIEFDFPEGILGLKIH

SEQ ID NO: 27674 - protein, 22 aa, artificial
  peptide fold or domain or sub-domain
TLRDVNEKVKINEQKDLNYYII

SEQ ID NO: 27675 - protein, 18 aa, artificial
  peptide fold or domain or sub-domain
KSRSSVAYGRDAEGASEK

SEQ ID NO: 27676 - protein, 22 aa, artificial
  peptide fold or domain or sub-domain
DLMAQFDTSSLRTNEGELIFSK

SEQ ID NO: 27677 - protein, 11 aa, artificial
  peptide fold or domain or sub-domain
GSFFATPDDRH

SEQ ID NO: 27678 - protein, 24 aa, artificial
  peptide fold or domain or sub-domain
VLDIKHEKLQIYRLKIMFYLYIMD

SEQ ID NO: 27679 - protein, 15 aa, artificial
  peptide fold or domain or sub-domain
KVILNNRIVPYDKAF

SEQ ID NO: 27680 - protein, 18 aa, artificial
  peptide fold or domain or sub-domain
MEPNKNKDLGLAVENQTY

SEQ ID NO: 27681 - protein, 30 aa, artificial
  peptide fold or domain or sub-domain
GKYVEKVEVKNGVVTAQMKPSTCRQPAAMN

SEQ ID NO: 27682 - protein, 19 aa, artificial
  peptide fold or domain or sub-domain
MTMITDSLAVVARTDRPSQ

SEQ ID NO: 27683 - protein, 30 aa, artificial
  peptide fold or domain or sub-domain
MWEPEIKVGTTSSAPSDRAPMAPAMPGGAA

SEQ ID NO: 27684 - protein, 22 aa, artificial
  peptide fold or domain or sub-domain
MEMKQINETTLKIMITMEDPST

SEQ ID NO: 27685 - protein, 28 aa, artificial
  peptide fold or domain or sub-domain
MLASVSGVRHRTLGTGILCYRGFLGNFA

SEQ ID NO: 27686 - protein, 30 aa, artificial
  peptide fold or domain or sub-domain
MTRRASTNVQTPIAGRAPMNQFGHATAFPD

SEQ ID NO: 27687 - protein, 29 aa, artificial
  peptide fold or domain or sub-domain
MPVCQGFRPRHGATGDRHTLGLKRDRSVN

SEQ ID NO: 27688 - protein, 25 aa, artificial
  peptide fold or domain or sub-domain
MGNYSGTNQQSSGNADCARWAVAKW

SEQ ID NO: 27689 - protein, 23 aa, artificial
  peptide fold or domain or sub-domain
MGSGGGETMAWTLAGFRERTMPP

SEQ ID NO: 27690 - protein, 30 aa, artificial
  peptide fold or domain or sub-domain
MRRKTSTSAGLDEDDAGMTVFSRMLQAPYK

SEQ ID NO: 27691 - protein, 26 aa, artificial
  peptide fold or domain or sub-domain
MKSCKSSGLRGWHGDRLPRLVAMANL

SEQ ID NO: 27692 - protein, 26 aa, artificial
  peptide fold or domain or sub-domain
MASTASSWLMPTRLWDALVRQRMIGR

SEQ ID NO: 27693 - protein, 30 aa, artificial
  peptide fold or domain or sub-domain
MSLFGQSDLALAMMLWSEGIVIGWPGTVVV

SEQ ID NO: 27694 - protein, 30 aa, artificial
  peptide fold or domain or sub-domain
MQLGWNRWALMEELVSIPAKPFALLGFNDE

SEQ ID NO: 27695 - protein, 26 aa, artificial
  peptide fold or domain or sub-domain
MPSSWVNDIATPPQGVRPDLPNRASY

SEQ ID NO: 27696 - protein, 27 aa, artificial
  peptide fold or domain or sub-domain
MGLALTMLAKDLLAHELKVSAMPSSRT

SEQ ID NO: 27697 - protein, 23 aa, artificial
  peptide fold or domain or sub-domain
MPAIEKGGHWMVLEASSGPRSMA

SEQ ID NO: 27698 - protein, 25 aa, artificial
  peptide fold or domain or sub-domain
MQRVKDEEILWNAPCRPPVRFGTMR

SEQ ID NO: 27699 - protein, 28 aa, artificial
  peptide fold or domain or sub-domain
MKHAHAQGFRLISPHGAKANRGAAGGIP

SEQ ID NO: 27700 - protein, 28 aa, artificial
  peptide fold or domain or sub-domain
MIVDQVLDSRFCVAPPTRLRKPRKSSGI

SEQ ID NO: 27701 - protein, 27 aa, artificial
  peptide fold or domain or sub-domain
MLISRDAFSERSSKGGSLQTHQTFQFS

SEQ ID NO: 27702 - protein, 26 aa, artificial
  peptide fold or domain or sub-domain
MHALQPLSSSAHRLETPLPAMTDDHA

SEQ ID NO: 27703 - protein, 30 aa, artificial
  peptide fold or domain or sub-domain
MESPGSDSSKSAQHPLMGRITALDPAHSAD

SEQ ID NO: 27704 - protein, 30 aa, artificial
  peptide fold or domain or sub-domain
MLCPKDCGLPLEPSSEGYSKRIGRIIWPGG

SEQ ID NO: 27705 - protein, 28 aa, artificial
  peptide fold or domain or sub-domain
MVAVATAGELSPHFIDCSGHLRKRWPFF

SEQ ID NO: 27706 - protein, 29 aa, artificial
  peptide fold or domain or sub-domain
MQADFFQKQADEIFEEESWKYLERIKSQP

SEQ ID NO: 27707 - protein, 30 aa, artificial
  peptide fold or domain or sub-domain
MLKMIGALLTQTAAMNPPIAHFDPTLQAAP

SEQ ID NO: 27708 - protein, 25 aa, artificial
  peptide fold or domain or sub-domain
MGKLRLQIGIMRNDALDVALISESL

SEQ ID NO: 27709 - protein, 28 aa, artificial
  peptide fold or domain or sub-domain
MIQNDLHAFCAVVTILVSIPIPIPALFG

SEQ ID NO: 27710 - protein, 21 aa, artificial
  peptide fold or domain or sub-domain
MKDIKILGVDIAKDVFSTVWN

SEQ ID NO: 27711 - protein, 28 aa, artificial
  peptide fold or domain or sub-domain
MLCIPMVMHKNPSDKSIYHWDFYALLGF

SEQ ID NO: 27712 - protein, 30 aa, artificial
  peptide fold or domain or sub-domain
MVQVAFGKEGHGGTTTRRLALRRASQAEAR

SEQ ID NO: 27713 - protein, 29 aa, artificial
  peptide fold or domain or sub-domain
MKRYVTGFNGLRTIGVLTVILYHLWGDPL

SEQ ID NO: 27714 - protein, 25 aa, artificial
  peptide fold or domain or sub-domain
MSRRGQRGEEPIDRVGLGVYYLWGE

SEQ ID NO: 27715 - protein, 28 aa, artificial
  peptide fold or domain or sub-domain
DAADDLGEGQHESPGPRGVAAVAHRASS

SEQ ID NO: 27716 - protein, 30 aa, artificial
  peptide fold or domain or sub-domain
MPAIRGPGEGSHAPVLEQHFGLGAREVVGP

SEQ ID NO: 27717 - protein, 27 aa, artificial
  peptide fold or domain or sub-domain
QWYRLSGRSERRCSDMGVSANWSGAPR

SEQ ID NO: 27718 - protein, 29 aa, artificial
  peptide fold or domain or sub-domain
MTASSETPVPESPGCAQKVASWSKSAEPS

SEQ ID NO: 27719 - protein, 17 aa, artificial
  peptide fold or domain or sub-domain
FVDHRAYNARQGLPPER

SEQ ID NO: 27720 - protein, 22 aa, artificial
  peptide fold or domain or sub-domain
MNAPALISELTRIGVELKVEDE

SEQ ID NO: 27721 - protein, 26 aa, artificial
  peptide fold or domain or sub-domain
MGSMYPVSMGLPTVQPRELKSFEVQS

SEQ ID NO: 27722 - protein, 30 aa, artificial
  peptide fold or domain or sub-domain
MGTSAERVESAWTWVSTVPMAPESSARRLA

SEQ ID NO: 27723 - protein, 30 aa, artificial
  peptide fold or domain or sub-domain
LCIEVSSARARSMHCCLSLAVSFRPPLLPR

SEQ ID NO: 27724 - protein, 19 aa, artificial
  peptide fold or domain or sub-domain
GMLRTGADFTDVFLDFSRV

SEQ ID NO: 27725 - protein, 27 aa, artificial
  peptide fold or domain or sub-domain
ELCMRSVFCERGIDCGANQFDRLEGGG

SEQ ID NO: 27726 - protein, 13 aa, artificial
  peptide fold or domain or sub-domain
MRHGQKRRSDEQG

SEQ ID NO: 27727 - protein, 26 aa, artificial
  peptide fold or domain or sub-domain
MPKRLSGPRLRWARGLWLSASSAARW

SEQ ID NO: 27728 - protein, 21 aa, artificial
  peptide fold or domain or sub-domain
PRCLSVLSHSRRASLDPRSPA

SEQ ID NO: 27729 - protein, 29 aa, artificial
  peptide fold or domain or sub-domain
MGVNVSDTNAEVMIATLRVTANSLKRRPT

SEQ ID NO: 27730 - protein, 19 aa, artificial
  peptide fold or domain or sub-domain
MPAMKAARLASERTRTGNC

SEQ ID NO: 27731 - protein, 25 aa, artificial
  peptide fold or domain or sub-domain
FCRSSTFFGGKDGWMDTTSGRAAIS

SEQ ID NO: 27732 - protein, 30 aa, artificial
  peptide fold or domain or sub-domain
MAEYACPSGQQELSRQKQTPASQRIPSGHA

SEQ ID NO: 27733 - protein, 30 aa, artificial
  peptide fold or domain or sub-domain
MPRAKCTSTASRFTKLRRTLGRLGLSTGAA

SEQ ID NO: 27734 - protein, 28 aa, artificial
  peptide fold or domain or sub-domain
EEAARVNSRASITTSGNPAAPGASNGRP

SEQ ID NO: 27735 - protein, 30 aa, artificial
  peptide fold or domain or sub-domain
MKPGGGVREGFRRVSPRWSKKPLSPAMPIE

SEQ ID NO: 27736 - protein, 21 aa, artificial
  peptide fold or domain or sub-domain
MRRSTSSGVTVRLYCLSAAEQ

SEQ ID NO: 27737 - protein, 29 aa, artificial
  peptide fold or domain or sub-domain
MVNTVRARARGVPWKPRRSATAARPVCQS

SEQ ID NO: 27738 - protein, 26 aa, artificial
  peptide fold or domain or sub-domain
MAIHPTRSPPAANSLDRPPSTTVLAP

SEQ ID NO: 27739 - protein, 30 aa, artificial
  peptide fold or domain or sub-domain
GVVVRHVLDGFFSPGARSPILFQHGRAVSR

SEQ ID NO: 27740 - protein, 29 aa, artificial
  peptide fold or domain or sub-domain
MTRSRNRASSWSSVHESPAPPAAAPAPGG

SEQ ID NO: 27741 - protein, 27 aa, artificial
  peptide fold or domain or sub-domain
MYIYNLPNQYSPEMILLFLWQTIKKIP

SEQ ID NO: 27742 - protein, 29 aa, artificial
  peptide fold or domain or sub-domain
MIETRGRKDLIEEGNKRVKLALDFLADEV

SEQ ID NO: 27743 - protein, 29 aa, artificial
  peptide fold or domain or sub-domain
MSNNAKYFEYTQAANIKMPAILAQYLVND

SEQ ID NO: 27744 - protein, 30 aa, artificial
  peptide fold or domain or sub-domain
MAGRAGAIEATVQEKSFMTDAGSGSGITTC

SEQ ID NO: 27745 - protein, 30 aa, artificial
  peptide fold or domain or sub-domain
MFARVKPAKPGYGCLKHAVGPMAGACQSEA

SEQ ID NO: 27746 - protein, 30 aa, artificial
  peptide fold or domain or sub-domain
MLPASDVQGCLRRASRLLHLNVLAAFTHLA

SEQ ID NO: 27747 - protein, 23 aa, artificial
  peptide fold or domain or sub-domain
MPLGEQREVQDSRQAVSVDRSTG

SEQ ID NO: 27748 - protein, 25 aa, artificial
  peptide fold or domain or sub-domain
MMYITRSEMILRFGEGEMIQLTDRS

SEQ ID NO: 27749 - protein, 29 aa, artificial
  peptide fold or domain or sub-domain
MDVFEEALNILAATAPPLYSAKIFIPRQI

SEQ ID NO: 27750 - protein, 24 aa, artificial
  peptide fold or domain or sub-domain
MEDGGKSLRSSGLRPAGYRVIIGA

SEQ ID NO: 27751 - protein, 26 aa, artificial
  peptide fold or domain or sub-domain
MPVSFFADEMVALFLIDKHTNDWRFE

SEQ ID NO: 27752 - protein, 25 aa, artificial
  peptide fold or domain or sub-domain
MIAHVNENIIVYLYIVEFAEVDYHG

SEQ ID NO: 27753 - protein, 30 aa, artificial
  peptide fold or domain or sub-domain
MVANPTQPIWQWNIKGDQFKAIPMALIYLM

SEQ ID NO: 27754 - protein, 27 aa, artificial
  peptide fold or domain or sub-domain
MALLMFGTGTKIRSLDHKRYQENPHAP

SEQ ID NO: 27755 - protein, 27 aa, artificial
  peptide fold or domain or sub-domain
MYSYSDGKLQRTKITGADGKLMVVENN

SEQ ID NO: 27756 - protein, 23 aa, artificial
  peptide fold or domain or sub-domain
MDTETAVVRLLVDSDAVIVIAGE

SEQ ID NO: 27757 - protein, 30 aa, artificial
  peptide fold or domain or sub-domain
MAGVIKADAAAMAAIEWLMIDFMMDELLNN

SEQ ID NO: 27758 - protein, 29 aa, artificial
  peptide fold or domain or sub-domain
MESREKIFLSGAYYELKPECLLPRTLMLK

SEQ ID NO: 27759 - protein, 27 aa, artificial
  peptide fold or domain or sub-domain
MRIIRPQISEEAKRLFVKLWPEPGKPH

SEQ ID NO: 27760 - protein, 29 aa, artificial
  peptide fold or domain or sub-domain
MVEPRFFTAGEQAVISGCSKHRDKHAHLW

SEQ ID NO: 27761 - protein, 23 aa, artificial
  peptide fold or domain or sub-domain
MSDFELRLLNFGRRNPDTLLEIF

SEQ ID NO: 27762 - protein, 24 aa, artificial
  peptide fold or domain or sub-domain
MVAFFMLIAKVNFNVLRWFACYAG

SEQ ID NO: 27763 - protein, 24 aa, artificial
  peptide fold or domain or sub-domain
MIMVGARSLQDTDWPTCGVIAPIF

SEQ ID NO: 27764 - protein, 29 aa, artificial
  peptide fold or domain or sub-domain
MWGATAETYHVMEVKKTQAKRDADSAIAV

SEQ ID NO: 27765 - protein, 28 aa, artificial
  peptide fold or domain or sub-domain
MLQLTGKTIPPPHKADTSRIALTPAAKA

SEQ ID NO: 27766 - protein, 27 aa, artificial
  peptide fold or domain or sub-domain
MICIAALSEALADKAPDISHAGVHLRP

SEQ ID NO: 27767 - protein, 29 aa, artificial
  peptide fold or domain or sub-domain
MAERGEHGQVLVGSGIMAEGIRYNVDGNG

SEQ ID NO: 27768 - protein, 25 aa, artificial
  peptide fold or domain or sub-domain
MWMAWSPAHMNQALTRLIVIGLEDG

SEQ ID NO: 27769 - protein, 30 aa, artificial
  peptide fold or domain or sub-domain
MRDDSFFQLILVVYALQAGGMGSADLCVWL

SEQ ID NO: 27770 - protein, 22 aa, artificial
  peptide fold or domain or sub-domain
MTEVGRFLPFAKAVLLIAMLGW

SEQ ID NO: 27771 - protein, 24 aa, artificial
  peptide fold or domain or sub-domain
MRGIVTGHMHPASGGATGRPEDDW

SEQ ID NO: 27772 - protein, 25 aa, artificial
  peptide fold or domain or sub-domain
MDNHHSKKAIDADALMPKMPASKAL

SEQ ID NO: 27773 - protein, 30 aa, artificial
  peptide fold or domain or sub-domain
MSVEQIVDEQFYQKFFSKVDKGIFIGKEGL

SEQ ID NO: 27774 - protein, 24 aa, artificial
  peptide fold or domain or sub-domain
MKSPDVLHANVVMHMSIYVPQITF

SEQ ID NO: 27775 - protein, 24 aa, artificial
  peptide fold or domain or sub-domain
MFQHGRLMPDFIGQAAEKGIYAVG

SEQ ID NO: 27776 - protein, 21 aa, artificial
  peptide fold or domain or sub-domain
MPPHVDKELLQLAYTQLGIQP

SEQ ID NO: 27777 - protein, 28 aa, artificial
  peptide fold or domain or sub-domain
MEDEEDQDMQIRYKTGHQFRKVNQLIVR

SEQ ID NO: 27778 - protein, 30 aa, artificial
  peptide fold or domain or sub-domain
MRRPPDQNSFNNKVKTKKRNDMKSSRFFNS

SEQ ID NO: 27779 - protein, 26 aa, artificial
  peptide fold or domain or sub-domain
MKDENVSAARMVILQEIEEAVSYVHI

SEQ ID NO: 27780 - protein, 26 aa, artificial
  peptide fold or domain or sub-domain
MSLNLAYLKAFLRAIKRSDQMFVATE

SEQ ID NO: 27781 - protein, 24 aa, artificial
  peptide fold or domain or sub-domain
MAQNMSLFGVVASDGNDTTGYDCL

SEQ ID NO: 27782 - protein, 28 aa, artificial
  peptide fold or domain or sub-domain
MSDELRFEIAQNMQRKLVDNLKDKVRIK

SEQ ID NO: 27783 - protein, 29 aa, artificial
  peptide fold or domain or sub-domain
MINESGRVVVGSAGISNKIVQLADDAFKD

SEQ ID NO: 27784 - protein, 30 aa, artificial
  peptide fold or domain or sub-domain
MIDLDWMTCLISRTIGAGRGRAARGSPNTF

SEQ ID NO: 27785 - protein, 26 aa, artificial
  peptide fold or domain or sub-domain
MKIHNKNEPKYIGSFFYLIEIDQKND

SEQ ID NO: 27786 - protein, 27 aa, artificial
  peptide fold or domain or sub-domain
FMEHCTREISDSHIPGMDAPPAATRPA

SEQ ID NO: 27787 - protein, 28 aa, artificial
  peptide fold or domain or sub-domain
MIRTRPAMASIVAGHTDTDPSGGGPFAA

SEQ ID NO: 27788 - protein, 28 aa, artificial
  peptide fold or domain or sub-domain
MNFTLVKLIQNVIMEFENMMVRRVLMCF

SEQ ID NO: 27789 - protein, 23 aa, artificial
  peptide fold or domain or sub-domain
MIFEKIEYRVDYNGDYNGGDNAS

SEQ ID NO: 27790 - protein, 27 aa, artificial
  peptide fold or domain or sub-domain
MKPAPVLLMIIAALGLSACGVPFVPLI

SEQ ID NO: 27791 - protein, 28 aa, artificial
  peptide fold or domain or sub-domain
MRQFFVNMFSQVTFYWEKRLTMHVCAAP

SEQ ID NO: 27792 - protein, 27 aa, artificial
  peptide fold or domain or sub-domain
MMRPPFAQQAAACALRNQSLQRDFTAW

SEQ ID NO: 27793 - protein, 30 aa, artificial
  peptide fold or domain or sub-domain
MAMLGYAGWGPGQLEEELAANGWLVCDATP

SEQ ID NO: 27794 - protein, 23 aa, artificial
  peptide fold or domain or sub-domain
MPGSPAPTRASSTRRCCCPQGPR

SEQ ID NO: 27795 - protein, 27 aa, artificial
  peptide fold or domain or sub-domain
MACCKTTATQMAIRSPSRWSRMSATEH

SEQ ID NO: 27796 - protein, 23 aa, artificial
  peptide fold or domain or sub-domain
MPSVSRIMNSPASIFTEAVSTKI

SEQ ID NO: 27797 - protein, 23 aa, artificial
  peptide fold or domain or sub-domain
MSSIEPIEEKIGWSDISGAFHVT

SEQ ID NO: 27798 - protein, 26 aa, artificial
  peptide fold or domain or sub-domain
MAKAAGTTAQPGWALPKKSSYSKPWP

SEQ ID NO: 27799 - protein, 27 aa, artificial
  peptide fold or domain or sub-domain
MPKPPQIACGCQPSLSTAGEPHLPIRT

SEQ ID NO: 27800 - protein, 21 aa, artificial
  peptide fold or domain or sub-domain
MIRDFFAKLFGGQAHGHAVHH

SEQ ID NO: 27801 - protein, 27 aa, artificial
  peptide fold or domain or sub-domain
MHDSGDPRWTTQRTPKSSPKPKPTAAP

SEQ ID NO: 27802 - protein, 26 aa, artificial
  peptide fold or domain or sub-domain
MLIATMILLSFMPARCWIAPEMPQAT

SEQ ID NO: 27803 - protein, 27 aa, artificial
  peptide fold or domain or sub-domain
MTCTRISSRWPWPSFWPPSSRKKSRAW

SEQ ID NO: 27804 - protein, 26 aa, artificial
  peptide fold or domain or sub-domain
MLLSLDPIGNDSRWCEPAVSPNTTRL

SEQ ID NO: 27805 - protein, 26 aa, artificial
  peptide fold or domain or sub-domain
MKASAPAGLRGGVSCWRSLMQRVSRP

SEQ ID NO: 27806 - protein, 24 aa, artificial
  peptide fold or domain or sub-domain
MASAPRRSPRCARQAPSRPADPLH

SEQ ID NO: 27807 - protein, 25 aa, artificial
  peptide fold or domain or sub-domain
MPPPAPTALKGRWPSASALTGWARR

SEQ ID NO: 27808 - protein, 28 aa, artificial
  peptide fold or domain or sub-domain
MRASACSISAGGSPAPIARICSPVSAPT

SEQ ID NO: 27809 - protein, 30 aa, artificial
  peptide fold or domain or sub-domain
MCLVPVSRCDDPSVEDRLRSRCKTAPGEGG

SEQ ID NO: 27810 - protein, 28 aa, artificial
  peptide fold or domain or sub-domain
MTEFDTSSSELSMLSHAARMPAQSIWPV

SEQ ID NO: 27811 - protein, 25 aa, artificial
  peptide fold or domain or sub-domain
MLTGMTPRSCASFEVRPPGKRIFRP

SEQ ID NO: 27812 - protein, 25 aa, artificial
  peptide fold or domain or sub-domain
MPWAEPRSPPCSNRRLLPACPGSGC

SEQ ID NO: 27813 - protein, 24 aa, artificial
  peptide fold or domain or sub-domain
MPRLVHFERKLTREEIRWTPCNGC

SEQ ID NO: 27814 - protein, 21 aa, artificial
  peptide fold or domain or sub-domain
MAHREHAFRVNRSLKRRTSPT

SEQ ID NO: 27815 - protein, 27 aa, artificial
  peptide fold or domain or sub-domain
MPAWPSTRPTAARSSGSRARAISPCVT

SEQ ID NO: 27816 - protein, 28 aa, artificial
  peptide fold or domain or sub-domain
MVKWPWLETQSCELPSVSYSATQACGSI

SEQ ID NO: 27817 - protein, 24 aa, artificial
  peptide fold or domain or sub-domain
MPSCTCGAPGAMASSMLMTCGSTS

SEQ ID NO: 27818 - protein, 25 aa, artificial
  peptide fold or domain or sub-domain
MRNSVPGKNHVLKWMFSAQGICRNL

SEQ ID NO: 27819 - protein, 30 aa, artificial
  peptide fold or domain or sub-domain
MEDKFDEDALTELLIANIYDSLDPESYGVD

SEQ ID NO: 27820 - protein, 29 aa, artificial
  peptide fold or domain or sub-domain
MPISPRERTLRPFICSSSVIGSLVLQMIG

SEQ ID NO: 27821 - protein, 29 aa, artificial
  peptide fold or domain or sub-domain
MTGSSVSGFAYALVRPRAGAPVARLTVQP

SEQ ID NO: 27822 - protein, 27 aa, artificial
  peptide fold or domain or sub-domain
MRAGSATSCTCAKSGGSCARREASLPP

SEQ ID NO: 27823 - protein, 27 aa, artificial
  peptide fold or domain or sub-domain
MSMILLLYQTLNRDLFAAAERVSSILI

SEQ ID NO: 27824 - protein, 26 aa, artificial
  peptide fold or domain or sub-domain
MKPTRLGQASQSRASVSACSTALSRL

SEQ ID NO: 27825 - protein, 26 aa, artificial
  peptide fold or domain or sub-domain
MVQEIAVPMVLGRMIRNEFQKNRPKV

SEQ ID NO: 27826 - protein, 30 aa, artificial
  peptide fold or domain or sub-domain
MTDMYDSWRSVKSCRNCLPAAGPDSAPGCP

SEQ ID NO: 27827 - protein, 26 aa, artificial
  peptide fold or domain or sub-domain
MTAEGRPGGPPFFMRRIRQDALSRRW

SEQ ID NO: 27828 - protein, 29 aa, artificial
  peptide fold or domain or sub-domain
MVALKQGRVLFDKPSGRVSQSDLNETFHG

SEQ ID NO: 27829 - protein, 29 aa, artificial
  peptide fold or domain or sub-domain
MGGHARGRGPIHQGKRLWDPLTASAPTPR

SEQ ID NO: 27830 - protein, 27 aa, artificial
  peptide fold or domain or sub-domain
MREKYTPSAWRLLATTMVCAVIPGQSQ

SEQ ID NO: 27831 - protein, 27 aa, artificial
  peptide fold or domain or sub-domain
MSISTGSAFAARPGSWCRTATRGAITG

SEQ ID NO: 27832 - protein, 21 aa, artificial
  peptide fold or domain or sub-domain
MQLFETALVEARTDFVSDTHA

SEQ ID NO: 27833 - protein, 30 aa, artificial
  peptide fold or domain or sub-domain
MTARISIRAVIVSTNRIVIRLIKLRTIGGA

SEQ ID NO: 27834 - protein, 25 aa, artificial
  peptide fold or domain or sub-domain
MATVSGDPLSNFTVVRSMFAVAPFG

SEQ ID NO: 27835 - protein, 30 aa, artificial
  peptide fold or domain or sub-domain
MAIAGRAHSKLLMSVFEAIAISQSVTVSML

SEQ ID NO: 27836 - protein, 27 aa, artificial
  peptide fold or domain or sub-domain
MVFKTESAKIVFRYVPLPRFAGAHLAE

SEQ ID NO: 27837 - protein, 25 aa, artificial
  peptide fold or domain or sub-domain
MFFLAVFLFFYGDFGGVPKLAVTAS

SEQ ID NO: 27838 - protein, 28 aa, artificial
  peptide fold or domain or sub-domain
MPYWLARPWHEILVWSAEAELIAAEDHG

SEQ ID NO: 27839 - protein, 30 aa, artificial
  peptide fold or domain or sub-domain
MTVDEISDLGVFDAEGTEVAEVSKVLGMGA

SEQ ID NO: 27840 - protein, 30 aa, artificial
  peptide fold or domain or sub-domain
METVEPSTSALACELEHAAGRIIVAEIEKR

SEQ ID NO: 27841 - protein, 24 aa, artificial
  peptide fold or domain or sub-domain
MIVVSLMIMLPPEYDARRPPLSFE

SEQ ID NO: 27842 - protein, 25 aa, artificial
  peptide fold or domain or sub-domain
MNRTGPLHFEEKFEAENAAEFLRKA

SEQ ID NO: 27843 - protein, 26 aa, artificial
  peptide fold or domain or sub-domain
MRFAFDGSLVCLFSNIVKKKTDLEGS

SEQ ID NO: 27844 - protein, 28 aa, artificial
  peptide fold or domain or sub-domain
MREIVFIAPVTVTVAGSHLRLMPKALEV

SEQ ID NO: 27845 - protein, 30 aa, artificial
  peptide fold or domain or sub-domain
MRRFAFAVEVFDVAVLRDSRDAAFIASKIA

SEQ ID NO: 27846 - protein, 25 aa, artificial
  peptide fold or domain or sub-domain
MGGCGEIARHGVFFEIAGTARRVPD

SEQ ID NO: 27847 - protein, 25 aa, artificial
  peptide fold or domain or sub-domain
MAFGAFKTFFETFSMIDFGDIHTRL

SEQ ID NO: 27848 - protein, 30 aa, artificial
  peptide fold or domain or sub-domain
MLLLELPCGMIFSVEDSRSLRIVNGAAIRL

SEQ ID NO: 27849 - protein, 27 aa, artificial
  peptide fold or domain or sub-domain
MRCDLKKNDLIDHDLSQLFPSSSIRPF

SEQ ID NO: 27850 - protein, 21 aa, artificial
  peptide fold or domain or sub-domain
MGILAYNLTRFVWHQRRGAPA

SEQ ID NO: 27851 - protein, 24 aa, artificial
  peptide fold or domain or sub-domain
MFAWRAGWSDILKKIYGTLLLGSC

SEQ ID NO: 27852 - protein, 29 aa, artificial
  peptide fold or domain or sub-domain
MLLIVLLSAMLPGEKDGNDKTFAIAEWAP

SEQ ID NO: 27853 - protein, 29 aa, artificial
  peptide fold or domain or sub-domain
MEAGKADYPVFGSAVFRGGDAVIDGRRER

SEQ ID NO: 27854 - protein, 23 aa, artificial
  peptide fold or domain or sub-domain
MAQAFAVIYRHPSIEHAGDTMNV

SEQ ID NO: 27855 - protein, 29 aa, artificial
  peptide fold or domain or sub-domain
MNYAFSRFLCNFDQGISAQRSQTIAMLLL

SEQ ID NO: 27856 - protein, 29 aa, artificial
  peptide fold or domain or sub-domain
MKQEGFAYEQIISVLKNHETGAGSTFTRR

SEQ ID NO: 27857 - protein, 26 aa, artificial
  peptide fold or domain or sub-domain
MAITSTTSSMAGFTIRMKIFAMITAR

SEQ ID NO: 27858 - protein, 25 aa, artificial
  peptide fold or domain or sub-domain
MIQSYPIVERFMKCDKAEAVVETPI

SEQ ID NO: 27859 - protein, 25 aa, artificial
  peptide fold or domain or sub-domain
MFTDGPGNCKQIIMPSANGQVVSIR

SEQ ID NO: 27860 - protein, 29 aa, artificial
  peptide fold or domain or sub-domain
MRFESERAKFEAIGMHAMIPKPRSDEGSP

SEQ ID NO: 27861 - protein, 26 aa, artificial
  peptide fold or domain or sub-domain
MMGVQENRLGEHEHAAAQIGLPIPDI

SEQ ID NO: 27862 - protein, 24 aa, artificial
  peptide fold or domain or sub-domain
MHEVKVCALQGRKAITQLHMIAKL

SEQ ID NO: 27863 - protein, 26 aa, artificial
  peptide fold or domain or sub-domain
MPQGDEYGRKALFYPIGLFAAPANRC

SEQ ID NO: 27864 - protein, 30 aa, artificial
  peptide fold or domain or sub-domain
MFGTVYHRYSLSMEVCSEVKRSPERYFSIT

SEQ ID NO: 27865 - protein, 27 aa, artificial
  peptide fold or domain or sub-domain
MKTRMQIDLAGRSPRQKFFSTAQKLAT

SEQ ID NO: 27866 - protein, 23 aa, artificial
  peptide fold or domain or sub-domain
MEGGFNFPAFYAVQALTMENFMN

SEQ ID NO: 27867 - protein, 23 aa, artificial
  peptide fold or domain or sub-domain
MHISDIAKENFLVAASVNVDPVK

SEQ ID NO: 27868 - protein, 30 aa, artificial
  peptide fold or domain or sub-domain
MHQHAMVHFGFRRSIKRLLARLGLFKMPAA

SEQ ID NO: 27869 - protein, 25 aa, artificial
  peptide fold or domain or sub-domain
MPIEIKTASEDVFDLSLLMRLGSFA

SEQ ID NO: 27870 - protein, 26 aa, artificial
  peptide fold or domain or sub-domain
MAEAVWRIANLRASDRGFNPVAHVSI

SEQ ID NO: 27871 - protein, 29 aa, artificial
  peptide fold or domain or sub-domain
MHQQFSAEPNTAILSGFIKGAGSLMALDA

SEQ ID NO: 27872 - protein, 29 aa, artificial
  peptide fold or domain or sub-domain
MINRINRLRLVWIVRIDNLLEPIELHDLR

SEQ ID NO: 27873 - protein, 30 aa, artificial
  peptide fold or domain or sub-domain
MLAAPIATLTRFESENFFSPAFQAVPDRSS

SEQ ID NO: 27874 - protein, 30 aa, artificial
  peptide fold or domain or sub-domain
MKAETLWKKIPLPARCGRHFVDNVRFFSPL

SEQ ID NO: 27875 - protein, 24 aa, artificial
  peptide fold or domain or sub-domain
MNKKFKYKKSLLAAILSATLVSRL

SEQ ID NO: 27876 - protein, 29 aa, artificial
  peptide fold or domain or sub-domain
MRRPSRSFMEDALKYEDPNTITQMLIIYQ

SEQ ID NO: 27877 - protein, 30 aa, artificial
  peptide fold or domain or sub-domain
MLPLCFLVGRLFDFKGIVNGEGELPQWNSN

SEQ ID NO: 27878 - protein, 27 aa, artificial
  peptide fold or domain or sub-domain
MFYEPDCCLDLQGYVPTTTIVDVLNGV

SEQ ID NO: 27879 - protein, 30 aa, artificial
  peptide fold or domain or sub-domain
MTPLDGTGSLHQTPEGWLLHVEACSRFSCQ

SEQ ID NO: 27880 - protein, 30 aa, artificial
  peptide fold or domain or sub-domain
MANSQFSTINVDEKGCDPIAYGSPSLVAYV

SEQ ID NO: 27881 - protein, 30 aa, artificial
  peptide fold or domain or sub-domain
MLSLVLSSSDVDGMNRPLTIGFERRALGFQ

SEQ ID NO: 27882 - protein, 30 aa, artificial
  peptide fold or domain or sub-domain
MAANQALPLIGMIAVLPKKRCFLNRSLVQA

SEQ ID NO: 27883 - protein, 30 aa, artificial
  peptide fold or domain or sub-domain
MPLFHLDETKALEPLEPGHPVPVLDSDRPE

SEQ ID NO: 27884 - protein, 25 aa, artificial
  peptide fold or domain or sub-domain
MCAFKKQPNSGKWCKGNASSQALHP

SEQ ID NO: 27885 - protein, 27 aa, artificial
  peptide fold or domain or sub-domain
MEKNIRTCLRQRKLNIIDAFLGYPENL

SEQ ID NO: 27886 - protein, 27 aa, artificial
  peptide fold or domain or sub-domain
MYATLIRLTAKRDLPAVSRRPETKSMT

SEQ ID NO: 27887 - protein, 25 aa, artificial
  peptide fold or domain or sub-domain
MRLLYDGHDSCIVMQDIEGNEFCLD

SEQ ID NO: 27888 - protein, 20 aa, artificial
  peptide fold or domain or sub-domain
MRRGVQNFEYQSSVPQCPRD

SEQ ID NO: 27889 - protein, 26 aa, artificial
  peptide fold or domain or sub-domain
MKVIGLDNTLVTGLSIGVRGHFIRLG

SEQ ID NO: 27890 - protein, 28 aa, artificial
  peptide fold or domain or sub-domain
MVPVPYCLDCLAPDTKIAWSSVYDDRTS

SEQ ID NO: 27891 - protein, 24 aa, artificial
  peptide fold or domain or sub-domain
MLRRVSPAASDAATWTSLQGYMVY

SEQ ID NO: 27892 - protein, 27 aa, artificial
  peptide fold or domain or sub-domain
MPCLSSPRDGGAERCGVVRVDRPESAF

SEQ ID NO: 27893 - protein, 26 aa, artificial
  peptide fold or domain or sub-domain
MTHVTLREKTFHNEGVAMQNHSVTPC

SEQ ID NO: 27894 - protein, 29 aa, artificial
  peptide fold or domain or sub-domain
MDEEGNDWFDETIRDQSWDHALDCLTSWL

SEQ ID NO: 27895 - protein, 29 aa, artificial
  peptide fold or domain or sub-domain
MGGHVRSDSSPFPRSPAGVADRVLHMLNV

SEQ ID NO: 27896 - protein, 28 aa, artificial
  peptide fold or domain or sub-domain
MCGSESWFVQVTVVPTFTVTVAGEKAKF

SEQ ID NO: 27897 - protein, 26 aa, artificial
  peptide fold or domain or sub-domain
MSGVPVVDVTQRSGIVQGRFAFGFTV

SEQ ID NO: 27898 - protein, 24 aa, artificial
  peptide fold or domain or sub-domain
MALGAITVVCAAGPRDTGSGPGQL

SEQ ID NO: 27899 - protein, 28 aa, artificial
  peptide fold or domain or sub-domain
MARVTSGLSRPSPMAGLAVKSLFDRRDG

SEQ ID NO: 27900 - protein, 29 aa, artificial
  peptide fold or domain or sub-domain
MRVTPAGRDRIAWQMTTACLIVQLRHSSF

SEQ ID NO: 27901 - protein, 24 aa, artificial
  peptide fold or domain or sub-domain
MRGSDLGKPLAECGDFPQIGMIFG

SEQ ID NO: 27902 - protein, 25 aa, artificial
  peptide fold or domain or sub-domain
MVEDDTSGVLVLADPESNEFCFVTG

SEQ ID NO: 27903 - protein, 29 aa, artificial
  peptide fold or domain or sub-domain
MGSPDRLAPKRTRVLVDVAVPCNGCPEWA

SEQ ID NO: 27904 - protein, 29 aa, artificial
  peptide fold or domain or sub-domain
MLQRGICFRIKYWLNREYYMLLFANERKA

SEQ ID NO: 27905 - protein, 29 aa, artificial
  peptide fold or domain or sub-domain
MCKHGKCFVPDFISVKIALNRRCKFLWLR

SEQ ID NO: 27906 - protein, 29 aa, artificial
  peptide fold or domain or sub-domain
MTDLPYIYESYPYLRQSFHLLAFETFLYF

SEQ ID NO: 27907 - protein, 23 aa, artificial
  peptide fold or domain or sub-domain
MPVAHTDAYRKEGFHYYCGHGWQ

SEQ ID NO: 27908 - protein, 23 aa, artificial
  peptide fold or domain or sub-domain
MRLRATACAAVEQSRYRDGFISS

SEQ ID NO: 27909 - protein, 26 aa, artificial
  peptide fold or domain or sub-domain
MTPSAAFFQECLGGDPPILADRDTSW

SEQ ID NO: 27910 - protein, 30 aa, artificial
  peptide fold or domain or sub-domain
MLILNCKKKVILIYMTLNVYSRGNGGEIYG

SEQ ID NO: 27911 - protein, 30 aa, artificial
  peptide fold or domain or sub-domain
MLILKIEGNNINDELIINLKWGEQIKYKSI

SEQ ID NO: 27912 - protein, 30 aa, artificial
  peptide fold or domain or sub-domain
MESKKNIFEKLKLDNILYIMYIREFKKKFI

SEQ ID NO: 27913 - protein, 29 aa, artificial
  peptide fold or domain or sub-domain
MSTDLKFSLVTTIIVLGLIVAVGLTAALH

SEQ ID NO: 27914 - protein, 30 aa, artificial
  peptide fold or domain or sub-domain
MLIIMGVKLTGHPFILIKHKLFLKYPIENG

SEQ ID NO: 27915 - protein, 22 aa, artificial
  peptide fold or domain or sub-domain
MLDLNERTGNKRVIAVLEYLKN

SEQ ID NO: 27916 - protein, 30 aa, artificial
  peptide fold or domain or sub-domain
MVVVQRVMAASFQGANTSSRKSPKLKAVGR

SEQ ID NO: 27917 - protein, 30 aa, artificial
  peptide fold or domain or sub-domain
MDTSARTCWMNWSGLVVAMGHLLYDVTLAM

SEQ ID NO: 27918 - protein, 30 aa, artificial
  peptide fold or domain or sub-domain
MSPFVQCEAFGFKGAACVFAFASLARSNLS

SEQ ID NO: 27919 - protein, 30 aa, artificial
  peptide fold or domain or sub-domain
MAALEMMEARNVAVGKIKYHHPGLLASQDT

SEQ ID NO: 27920 - protein, 30 aa, artificial
  peptide fold or domain or sub-domain
MHFLIRRAHKKIRPEHIRGGLFDLISNVRL

SEQ ID NO: 27921 - protein, 30 aa, artificial
  peptide fold or domain or sub-domain
MVASQGCMAEGRMRRVTGYHATSRAILKAL

SEQ ID NO: 27922 - protein, 30 aa, artificial
  peptide fold or domain or sub-domain
MDIASGVTEQVIQNRATAPAYEPKRRRTPQ

SEQ ID NO: 27923 - protein, 30 aa, artificial
  peptide fold or domain or sub-domain
MSGTLVITRPDVFADLRRGVFGVLPPRTRG

SEQ ID NO: 27924 - protein, 30 aa, artificial
  peptide fold or domain or sub-domain
MKIKDNTLEINQAKNTYLFKAKNTKIIREY

SEQ ID NO: 27925 - protein, 30 aa, artificial
  peptide fold or domain or sub-domain
MIRIRSPTKKKLNRNSISDWKSNTSGRFFY

SEQ ID NO: 27926 - protein, 21 aa, artificial
  peptide fold or domain or sub-domain
MRYITYSLIPRLLSKKVIHQQ

SEQ ID NO: 27927 - protein, 29 aa, artificial
  peptide fold or domain or sub-domain
MKQHSKRLKVALYLNFRFFKLKVAIFFVK

SEQ ID NO: 27928 - protein, 18 aa, artificial
  peptide fold or domain or sub-domain
MRVLKFGGTSLANPERFS

SEQ ID NO: 27929 - protein, 18 aa, artificial
  peptide fold or domain or sub-domain
MKDMIMKTDRLILRKMRR

SEQ ID NO: 27930 - protein, 27 aa, artificial
  peptide fold or domain or sub-domain
MSKELTALASSPLYIVKEKVLNDYSVE

SEQ ID NO: 27931 - protein, 28 aa, artificial
  peptide fold or domain or sub-domain
MKARSETRIKQMAVVAAAGIGAVSQRGH

SEQ ID NO: 27932 - protein, 27 aa, artificial
  peptide fold or domain or sub-domain
MNGEAASFVYDIMCPKDARYWLHLHFT

SEQ ID NO: 27933 - protein, 30 aa, artificial
  peptide fold or domain or sub-domain
MSPLWRDLLFRPADFEGFKPPCEANNVLVN

SEQ ID NO: 27934 - protein, 25 aa, artificial
  peptide fold or domain or sub-domain
MWDASYFVLGSVLLIILYGYLFGVI

SEQ ID NO: 27935 - protein, 27 aa, artificial
  peptide fold or domain or sub-domain
MDYKKEAKSDSLQVEEISARLLRVMGA

SEQ ID NO: 27936 - protein, 30 aa, artificial
  peptide fold or domain or sub-domain
MTSLLSTLKLYHVSKKNSKEDPKSKEIPFF

SEQ ID NO: 27937 - protein, 30 aa, artificial
  peptide fold or domain or sub-domain
MLDAAVKKRRIAKKTDTIPNQGRLFKNRFI

SEQ ID NO: 27938 - protein, 16 aa, artificial
  peptide fold or domain or sub-domain
EKVVLKPYQTLAILVK

SEQ ID NO: 27939 - protein, 27 aa, artificial
  peptide fold or domain or sub-domain
VVQNTIERLMHNKWFALKGPYYAGIFS

SEQ ID NO: 27940 - protein, 29 aa, artificial
  peptide fold or domain or sub-domain
MMNPRFFYCIEPISTLEQAGIVVYMLLAQ

SEQ ID NO: 27941 - protein, 26 aa, artificial
  peptide fold or domain or sub-domain
GGADKIKGPYRPLKNGMSTEFNKKLN

SEQ ID NO: 27942 - protein, 20 aa, artificial
  peptide fold or domain or sub-domain
KPEGIQDALNAFDAWAQQNL

SEQ ID NO: 27943 - protein, 26 aa, artificial
  peptide fold or domain or sub-domain
MDRKAIAKEFENAEKQSRENCPTDFV

SEQ ID NO: 27944 - protein, 23 aa, artificial
  peptide fold or domain or sub-domain
MKLMDFWLFFSEPLEEAKELPHQ

SEQ ID NO: 27945 - protein, 28 aa, artificial
  peptide fold or domain or sub-domain
MSFHDLIVDVPDHITQNGHIYRIEESDR

SEQ ID NO: 27946 - protein, 28 aa, artificial
  peptide fold or domain or sub-domain
MKFKRRELRTTMTTDYHVKAFNPIGRLE

SEQ ID NO: 27947 - protein, 21 aa, artificial
  peptide fold or domain or sub-domain
MPEMIGWPQVGYFSLAAGLSL

SEQ ID NO: 27948 - protein, 26 aa, artificial
  peptide fold or domain or sub-domain
MFLFFINILVRMSHAWDMHLFNRVFV

SEQ ID NO: 27949 - protein, 27 aa, artificial
  peptide fold or domain or sub-domain
MGAGKIERIASLSARFWRNAESAPTGV

SEQ ID NO: 27950 - protein, 30 aa, artificial
  peptide fold or domain or sub-domain
MDDYPIFAALIPQGDGIHMRAGGPAQTGGL

SEQ ID NO: 27951 - protein, 29 aa, artificial
  peptide fold or domain or sub-domain
MLRDAVQKLDRRYPLFGTRWHKTGGRATA

SEQ ID NO: 27952 - protein, 30 aa, artificial
  peptide fold or domain or sub-domain
MSPQSPDPYWRNRHPFVANADFHVALHNQI

SEQ ID NO: 27953 - protein, 30 aa, artificial
  peptide fold or domain or sub-domain
MADAFHFKSRGFRLAFRQYSHQDRFLNEQL

SEQ ID NO: 27954 - protein, 27 aa, artificial
  peptide fold or domain or sub-domain
MHNFPIAGKDAALLEARKTKIMARRPT

SEQ ID NO: 27955 - protein, 27 aa, artificial
  peptide fold or domain or sub-domain
MESFAIMGVVVALGSIVYRASIRRSST

SEQ ID NO: 27956 - protein, 30 aa, artificial
  peptide fold or domain or sub-domain
MMFPWQHYSVRLSPMWMSFSPKAASTAKPL

SEQ ID NO: 27957 - protein, 30 aa, artificial
  peptide fold or domain or sub-domain
MRYISKHKPWIILHLIFINMATQKLFLTRV

SEQ ID NO: 27958 - protein, 25 aa, artificial
  peptide fold or domain or sub-domain
MHLAIFRIFLLIVDRMLGTGKRAVR

SEQ ID NO: 27959 - protein, 25 aa, artificial
  peptide fold or domain or sub-domain
MHRWRAFSLSQVFQDASPVLRNKAI

SEQ ID NO: 27960 - protein, 23 aa, artificial
  peptide fold or domain or sub-domain
MMAMLDKAAATAYRLGDKEEKRM

SEQ ID NO: 27961 - protein, 29 aa, artificial
  peptide fold or domain or sub-domain
MPPTRFGRSSARDPRLVFDCGAAANRERD

SEQ ID NO: 27962 - protein, 29 aa, artificial
  peptide fold or domain or sub-domain
MFSPMTDFERAAETINLIALLFRSKGVVG

SEQ ID NO: 27963 - protein, 30 aa, artificial
  peptide fold or domain or sub-domain
MHSSFLAVPDGSADSGEISPAGRDEQMQNY

SEQ ID NO: 27964 - protein, 23 aa, artificial
  peptide fold or domain or sub-domain
MARDQMIIEAPRADVVMLGNTLR

SEQ ID NO: 27965 - protein, 30 aa, artificial
  peptide fold or domain or sub-domain
MAWSISLIETNHCAADGQDRYKLALTCVAA

SEQ ID NO: 27966 - protein, 26 aa, artificial
  peptide fold or domain or sub-domain
MAIALVTRLPVDPEVAEMSANADTML

SEQ ID NO: 27967 - protein, 29 aa, artificial
  peptide fold or domain or sub-domain
MRHNPGANEHALFEAFSQSVLENAISTGA

SEQ ID NO: 27968 - protein, 25 aa, artificial
  peptide fold or domain or sub-domain
MVKSSFFFSRIYFSPIFFLGEYPNN

SEQ ID NO: 27969 - protein, 28 aa, artificial
  peptide fold or domain or sub-domain
MFYNLKSAVNCRIWVQGGLKCLKQFSKC

SEQ ID NO: 27970 - protein, 26 aa, artificial
  peptide fold or domain or sub-domain
MLDTLNNIRLSVILEETKARGRVKAN

SEQ ID NO: 27971 - protein, 26 aa, artificial
  peptide fold or domain or sub-domain
MMLMSIEVFLAMDKKMKQNVFNIIQN

SEQ ID NO: 27972 - protein, 29 aa, artificial
  peptide fold or domain or sub-domain
MGRIGVILNIECFDKREHTLFYTIWGVVL

SEQ ID NO: 27973 - protein, 21 aa, artificial
  peptide fold or domain or sub-domain
MYIIYIFQEGLQMEQLIGMKN

SEQ ID NO: 27974 - protein, 26 aa, artificial
  peptide fold or domain or sub-domain
DLQHLLLSPAFLGEQKQEGKMPQKRE

SEQ ID NO: 27975 - protein, 26 aa, artificial
  peptide fold or domain or sub-domain
MMNQKLFKLIKRLEPRVRCTQLAQVL

SEQ ID NO: 27976 - protein, 26 aa, artificial
  peptide fold or domain or sub-domain
MQPSKQKGCNKIVSKMEGTMYLEQRT

SEQ ID NO: 27977 - protein, 24 aa, artificial
  peptide fold or domain or sub-domain
MELGLIITFIIAAAVMVKKEMAKQ

SEQ ID NO: 27978 - protein, 30 aa, artificial
  peptide fold or domain or sub-domain
WQVDADKFMAHNLVGEGPKYATNMKSAMKV

SEQ ID NO: 27979 - protein, 24 aa, artificial
  peptide fold or domain or sub-domain
MENIENMTYAPVSDVLKGQLAVDS

SEQ ID NO: 27980 - protein, 28 aa, artificial
  peptide fold or domain or sub-domain
MIPHKTNASDENAASMGCFSAQVAVPKA

SEQ ID NO: 27981 - protein, 30 aa, artificial
  peptide fold or domain or sub-domain
MIKKNLAFLALFALSIEASELNNKNLQELE

SEQ ID NO: 27982 - protein, 24 aa, artificial
  peptide fold or domain or sub-domain
ILKGRVDSRIIFDTPTEKIVTIDL

SEQ ID NO: 27983 - protein, 23 aa, artificial
  peptide fold or domain or sub-domain
GGLLDANKFQNTAKILSVQASYK

SEQ ID NO: 27984 - protein, 29 aa, artificial
  peptide fold or domain or sub-domain
AAAYDHACFELISASQEGDSLMPFELTRA

SEQ ID NO: 27985 - protein, 29 aa, artificial
  peptide fold or domain or sub-domain
SIVTPNLELKNMASDILGDKFFLQGERSA

SEQ ID NO: 27986 - protein, 20 aa, artificial
  peptide fold or domain or sub-domain
SRQIEEKALEKLQKEISNIR

SEQ ID NO: 27987 - protein, 24 aa, artificial
  peptide fold or domain or sub-domain
MINEVELTEIKARINIKYKRRDTL

SEQ ID NO: 27988 - protein, 29 aa, artificial
  peptide fold or domain or sub-domain
MMPDVEDLEKIVKRELKKLEEYDDSIKEK

SEQ ID NO: 27989 - protein, 20 aa, artificial
  peptide fold or domain or sub-domain
MTPHINASKEDIAEIVLMPG

SEQ ID NO: 27990 - protein, 26 aa, artificial
  peptide fold or domain or sub-domain
DDGGVKAKFRRASPQGPFFTFHFNLK

SEQ ID NO: 27991 - protein, 23 aa, artificial
  peptide fold or domain or sub-domain
MEETMDQVSPFIYPGDEGAKLMP

SEQ ID NO: 27992 - protein, 20 aa, artificial
  peptide fold or domain or sub-domain
MKRDLPKAAVGESDHFVNGH

SEQ ID NO: 27993 - protein, 30 aa, artificial
  peptide fold or domain or sub-domain
MTKSVQRAKNGRGILESLIQMATFEPGVVA

SEQ ID NO: 27994 - protein, 24 aa, artificial
  peptide fold or domain or sub-domain
MFVASRIENQENSSEVLWAPGKNK

SEQ ID NO: 27995 - protein, 25 aa, artificial
  peptide fold or domain or sub-domain
YTIILKYSKFLLKIIRKLKLNEKIF

SEQ ID NO: 27996 - protein, 23 aa, artificial
  peptide fold or domain or sub-domain
MAFTGLILMIPEDNYIVYIGMGL

SEQ ID NO: 27997 - protein, 30 aa, artificial
  peptide fold or domain or sub-domain
MTLTLKETETKLKTTKFENLPKPRKNKGVR

SEQ ID NO: 27998 - protein, 25 aa, artificial
  peptide fold or domain or sub-domain
MKTYISFSKDDSIESLVDATCIGAL

SEQ ID NO: 27999 - protein, 27 aa, artificial
  peptide fold or domain or sub-domain
MEFNINKNDLVEPALLASNVSKKGSLF

SEQ ID NO: 28000 - protein, 27 aa, artificial
  peptide fold or domain or sub-domain
MIRVNVAKLAPKNDISQMAMIGADRFL

SEQ ID NO: 28001 - protein, 30 aa, artificial
  peptide fold or domain or sub-domain
LGKYDDGIFYADEVLAKHDENYMPPSLEIN

SEQ ID NO: 28002 - protein, 30 aa, artificial
  peptide fold or domain or sub-domain
MPFFGGSVGVVEREVAEVLLQPALWCPKKH

SEQ ID NO: 28003 - protein, 26 aa, artificial
  peptide fold or domain or sub-domain
MEPQLIAAIISGSVGAFAGISRALEI

SEQ ID NO: 28004 - protein, 28 aa, artificial
  peptide fold or domain or sub-domain
FDLAQTADAFRALTGRKTTGVTLIETGL

SEQ ID NO: 28005 - protein, 21 aa, artificial
  peptide fold or domain or sub-domain
MHKEFKCGEANVKILKPNWLN

SEQ ID NO: 28006 - protein, 25 aa, artificial
  peptide fold or domain or sub-domain
GAQEDFELLVVYHWMIAMKVFNIFL

SEQ ID NO: 28007 - protein, 30 aa, artificial
  peptide fold or domain or sub-domain
MQVQIFQEIQLQQIATATTAPALAPTSKAG

SEQ ID NO: 28008 - protein, 30 aa, artificial
  peptide fold or domain or sub-domain
MVDGNIIKHSVSQLIDTFFPEFDSEYWSRI

SEQ ID NO: 28009 - protein, 28 aa, artificial
  peptide fold or domain or sub-domain
ACDVSGLQKKAHKSGSPVFDGQPITCRR

SEQ ID NO: 28010 - protein, 30 aa, artificial
  peptide fold or domain or sub-domain
MKDNEASDDWKRYGGKLISAISRASSTATG

SEQ ID NO: 28011 - protein, 29 aa, artificial
  peptide fold or domain or sub-domain
MAAVANKGKQVVSELSSAIVEVLALPTAI

SEQ ID NO: 28012 - protein, 23 aa, artificial
  peptide fold or domain or sub-domain
GNGGKLEQSIIWIIKKINAKNKP

SEQ ID NO: 28013 - protein, 25 aa, artificial
  peptide fold or domain or sub-domain
AILVGEHLLKQNDLGAEVKKMLSKL

SEQ ID NO: 28014 - protein, 29 aa, artificial
  peptide fold or domain or sub-domain
MRFFSGGFIPYFSMVKRYSLLMIPLDAKF

SEQ ID NO: 28015 - protein, 25 aa, artificial
  peptide fold or domain or sub-domain
MQLLDLIIIATFSKQERGKYSSFLF

SEQ ID NO: 28016 - protein, 29 aa, artificial
  peptide fold or domain or sub-domain
MLLSKSAKSFDLALEQKKIKQNKKIWLSA

SEQ ID NO: 28017 - protein, 29 aa, artificial
  peptide fold or domain or sub-domain
MIFKSLYIINLSLGVFEQTFLNLNILGVS

SEQ ID NO: 28018 - protein, 29 aa, artificial
  peptide fold or domain or sub-domain
MKHNLFGLGGGGKRQAIFIFLGTIKMKCA

SEQ ID NO: 28019 - protein, 27 aa, artificial
  peptide fold or domain or sub-domain
MSLDYKKLVTNFFTSKYYKDQSELRNV

SEQ ID NO: 28020 - protein, 30 aa, artificial
  peptide fold or domain or sub-domain
MLNFDSNIDIMINFSFLDYKLKTGRLKDWV

SEQ ID NO: 28021 - protein, 23 aa, artificial
  peptide fold or domain or sub-domain
MVDAKQQKILSINRFFIIMWIWV

SEQ ID NO: 28022 - protein, 25 aa, artificial
  peptide fold or domain or sub-domain
MGSVDAESAEKQNKVTAKTELNLAK

SEQ ID NO: 28023 - protein, 28 aa, artificial
  peptide fold or domain or sub-domain
MGRKSGFIKALLMGLYNFKQVFAGKPKI

SEQ ID NO: 28024 - protein, 27 aa, artificial
  peptide fold or domain or sub-domain
MSQFVENQLLENETVLFETHHHWTNYF

SEQ ID NO: 28025 - protein, 28 aa, artificial
  peptide fold or domain or sub-domain
MFQKIRYEMSKRDDRHTLVDELDEVFLK

SEQ ID NO: 28026 - protein, 29 aa, artificial
  peptide fold or domain or sub-domain
MQEEMRKLNFLFVAKYFIKILKKSRKSHK

SEQ ID NO: 28027 - protein, 25 aa, artificial
  peptide fold or domain or sub-domain
MLNQINSKLDTKKNPFILKGIFFVQ

SEQ ID NO: 28028 - protein, 30 aa, artificial
  peptide fold or domain or sub-domain
MENKALIMKKLIRAPSNKNSVGPLLKNFKT

SEQ ID NO: 28029 - protein, 26 aa, artificial
  peptide fold or domain or sub-domain
MKTLSKGWSFAQRLSAIAAIIKTLKT

SEQ ID NO: 28030 - protein, 26 aa, artificial
  peptide fold or domain or sub-domain
MLAIIVKNKSNTITFTNFDKTDKKNG

SEQ ID NO: 28031 - protein, 25 aa, artificial
  peptide fold or domain or sub-domain
MHAKQTSKELLNNQDPQEEIKKQAS

SEQ ID NO: 28032 - protein, 29 aa, artificial
  peptide fold or domain or sub-domain
MKSKIRLNEIAKMRAKLVQAQNQMINGWI

SEQ ID NO: 28033 - protein, 22 aa, artificial
  peptide fold or domain or sub-domain
MEKNIEKMAQQLNGMMDVKNGG

SEQ ID NO: 28034 - protein, 24 aa, artificial
  peptide fold or domain or sub-domain
MIADSLPDTFGHIIFQEWLTPRGI

SEQ ID NO: 28035 - protein, 24 aa, artificial
  peptide fold or domain or sub-domain
MKGLPNLKIDVFHFYVDFNFLDEE

SEQ ID NO: 28036 - protein, 30 aa, artificial
  peptide fold or domain or sub-domain
MQLLKLENYFLAQGETTSLRTAARKSNIFI

SEQ ID NO: 28037 - protein, 30 aa, artificial
  peptide fold or domain or sub-domain
MTRLHPFREKKSGLTPFHILLHKLAGLSIN

SEQ ID NO: 28038 - protein, 30 aa, artificial
  peptide fold or domain or sub-domain
MMSLMRAFNWLRALNSIAGILLLKFFYIIA

SEQ ID NO: 28039 - protein, 30 aa, artificial
  peptide fold or domain or sub-domain
MEILGILPRDSMITTIKVIFGYTKIIFAFT

SEQ ID NO: 28040 - protein, 30 aa, artificial
  peptide fold or domain or sub-domain
MPSRSSLAGNRRNKGVAGKKKNERQTQRNP

SEQ ID NO: 28041 - protein, 30 aa, artificial
  peptide fold or domain or sub-domain
MTPAKALSASFFIIPGEGGVLIFKRNSLEI

SEQ ID NO: 28042 - protein, 30 aa, artificial
  peptide fold or domain or sub-domain
MAIKEKQMDLIEKAKALKIYIAWMIVNYLF

SEQ ID NO: 28043 - protein, 30 aa, artificial
  peptide fold or domain or sub-domain
MEISNAEVGLEEEACFAHFCLPESFSVVSF

SEQ ID NO: 28044 - protein, 30 aa, artificial
  peptide fold or domain or sub-domain
MPATSEQAGNKTGRPAVEKSPNKSFHREVS

SEQ ID NO: 28045 - protein, 30 aa, artificial
  peptide fold or domain or sub-domain
MYPDRERGKVEARRGKLAEHGPGAALPKEE

SEQ ID NO: 28046 - protein, 30 aa, artificial
  peptide fold or domain or sub-domain
MAVSRVSPGNQNAVRTFLKGPQYKLRINPP

SEQ ID NO: 28047 - protein, 30 aa, artificial
  peptide fold or domain or sub-domain
MLYQGNVIRLKASAGGREKPKRIKTALARK

SEQ ID NO: 28048 - protein, 30 aa, artificial
  peptide fold or domain or sub-domain
MLRGFKCRIAGQMIDFQENKGGPAGPLVRG

SEQ ID NO: 28049 - protein, 30 aa, artificial
  peptide fold or domain or sub-domain
MANKTVTNKGVKNKTVANKTITENPIFDGK

SEQ ID NO: 28050 - protein, 28 aa, artificial
  peptide fold or domain or sub-domain
MDINYLKNLKKQGSLAVNLCVDNQKVSR

SEQ ID NO: 28051 - protein, 30 aa, artificial
  peptide fold or domain or sub-domain
MVINVGFAVGKPNIDAVFLLAIANNYSLLF

SEQ ID NO: 28052 - protein, 25 aa, artificial
  peptide fold or domain or sub-domain
MEKMQTKTLAQLVQMVVEAGDRESL

SEQ ID NO: 28053 - protein, 21 aa, artificial
  peptide fold or domain or sub-domain
MIGVNFYRTTNAAEKDNKLDM

SEQ ID NO: 28054 - protein, 25 aa, artificial
  peptide fold or domain or sub-domain
MLPVNDKFAGKKNRHPGAGFFILVN

SEQ ID NO: 28055 - protein, 29 aa, artificial
  peptide fold or domain or sub-domain
MQPRAAKSDDNYRAHGGHGGTEFDIEGWL

SEQ ID NO: 28056 - protein, 25 aa, artificial
  peptide fold or domain or sub-domain
MSHVGQIKNGCHELEPPAMRPNQQA

SEQ ID NO: 28057 - protein, 28 aa, artificial
  peptide fold or domain or sub-domain
MPNMLFEVLLAIAAIVVAIGLYSAAVMS

SEQ ID NO: 28058 - protein, 24 aa, artificial
  peptide fold or domain or sub-domain
PYLYNSTQKSLYEQKAIKQLIASA

SEQ ID NO: 28059 - protein, 26 aa, artificial
  peptide fold or domain or sub-domain
MKRRELKLLGIVITIFLFTLMIGRAA

SEQ ID NO: 28060 - protein, 25 aa, artificial
  peptide fold or domain or sub-domain
MKDDSMAEAEFSATIADYYDYVGLA

SEQ ID NO: 28061 - protein, 26 aa, artificial
  peptide fold or domain or sub-domain
MEIVVFTNKKATMLDIKVAYKTNNKV

SEQ ID NO: 28062 - protein, 26 aa, artificial
  peptide fold or domain or sub-domain
MVALIGLFAIGFIIWWFWLHPATKAK

SEQ ID NO: 28063 - protein, 30 aa, artificial
  peptide fold or domain or sub-domain
MSSDWLDVVMVTGWISAWAVLIYLIPAAGF

SEQ ID NO: 28064 - protein, 24 aa, artificial
  peptide fold or domain or sub-domain
MARIFEKIISLYQPSFVELYKNGH

SEQ ID NO: 28065 - protein, 29 aa, artificial
  peptide fold or domain or sub-domain
MVVKSVTSHIRIPIKVFLGPDLSPGRVDP

SEQ ID NO: 28066 - protein, 28 aa, artificial
  peptide fold or domain or sub-domain
MDLKALAVMQGRFIVSNQPMGRNIQIVH

SEQ ID NO: 28067 - protein, 25 aa, artificial
  peptide fold or domain or sub-domain
ANKNFDFTTKKHDKIDIESKRYQFV

SEQ ID NO: 28068 - protein, 27 aa, artificial
  peptide fold or domain or sub-domain
MSEDCHEGCLKAEHSSGRYINAYQRLI

SEQ ID NO: 28069 - protein, 27 aa, artificial
  peptide fold or domain or sub-domain
MASPASLYSLYFDEEFAGLVVSTAMTR

SEQ ID NO: 28070 - protein, 30 aa, artificial
  peptide fold or domain or sub-domain
MTLQLVDTLLNVNVFIFVGVLVWLFIKKDS

SEQ ID NO: 28071 - protein, 27 aa, artificial
  peptide fold or domain or sub-domain
MIAQVIVDGGVQQIGKGIKRLENMWPD

SEQ ID NO: 28072 - protein, 26 aa, artificial
  peptide fold or domain or sub-domain
MIICDGMLQLKMEGCLYRQLMEEGEQ

SEQ ID NO: 28073 - protein, 27 aa, artificial
  peptide fold or domain or sub-domain
MTYTLQGVAGEDDNVTGDLDIYSSDNI

SEQ ID NO: 28074 - protein, 30 aa, artificial
  peptide fold or domain or sub-domain
MLLTVALEYQFFLKGNFISDMQGSKKEFNI

SEQ ID NO: 28075 - protein, 26 aa, artificial
  peptide fold or domain or sub-domain
PNKTFYEAKDVGFAPMRRKPKMDEPA

SEQ ID NO: 28076 - protein, 25 aa, artificial
  peptide fold or domain or sub-domain
LLLKDRFIFIEKAEFGFYSHFFEVY

SEQ ID NO: 28077 - protein, 21 aa, artificial
  peptide fold or domain or sub-domain
MLNPMEDIELAISVIDSGIFE

SEQ ID NO: 28078 - protein, 27 aa, artificial
  peptide fold or domain or sub-domain
MDLKGNRQRIKRLFFSKKTGQQKQLTR

SEQ ID NO: 28079 - protein, 30 aa, artificial
  peptide fold or domain or sub-domain
MIVPYGSCEIILNNKLAKLISKKSKARIEI

SEQ ID NO: 28080 - protein, 24 aa, artificial
  peptide fold or domain or sub-domain
MSTHSALLRYGLKVTLNNKKERIK

SEQ ID NO: 28081 - protein, 23 aa, artificial
  peptide fold or domain or sub-domain
MSLRKASRRIAILILCIYKGVPE

SEQ ID NO: 28082 - protein, 26 aa, artificial
  peptide fold or domain or sub-domain
MVIDKLVDLPDDCFNLIWQSIFKGTL

SEQ ID NO: 28083 - protein, 27 aa, artificial
  peptide fold or domain or sub-domain
ALMISDAMPVVELSPELASLEDRFEHF

SEQ ID NO: 28084 - protein, 25 aa, artificial
  peptide fold or domain or sub-domain
MPAVELGGGIKGIDAKEFVWLLQTP

SEQ ID NO: 28085 - protein, 30 aa, artificial
  peptide fold or domain or sub-domain
MGIGCVDPRYYWQNEKDATMCLLFFNEFLI

SEQ ID NO: 28086 - protein, 28 aa, artificial
  peptide fold or domain or sub-domain
MLKNNLAITDKKNQHYAGFFMRYIDIFY

SEQ ID NO: 28087 - protein, 27 aa, artificial
  peptide fold or domain or sub-domain
MRTNMVGIMVNKKERIGFITVSIKVQN

SEQ ID NO: 28088 - protein, 30 aa, artificial
  peptide fold or domain or sub-domain
MIQPNIDNKQRQVIFSKAILPSLLDVGTKR

SEQ ID NO: 28089 - protein, 30 aa, artificial
  peptide fold or domain or sub-domain
MSRSLGRKRFWFQQNRPVNTINTQTKEAVK

SEQ ID NO: 28090 - protein, 22 aa, artificial
  peptide fold or domain or sub-domain
MHQFGAFDLNKPIDGLGNQQGC

SEQ ID NO: 28091 - protein, 29 aa, artificial
  peptide fold or domain or sub-domain
MNIDNLNRVINIKSPMLALGFLLDDITND

SEQ ID NO: 28092 - protein, 27 aa, artificial
  peptide fold or domain or sub-domain
MRKVWVERNKEKAMKNLAAYTARLLIC

SEQ ID NO: 28093 - protein, 25 aa, artificial
  peptide fold or domain or sub-domain
MVGYWRVSCAVALFKRVFKVNYNAA

SEQ ID NO: 28094 - protein, 28 aa, artificial
  peptide fold or domain or sub-domain
MSSVLNIDKFGNFGVNNLKIELLFISNG

SEQ ID NO: 28095 - protein, 28 aa, artificial
  peptide fold or domain or sub-domain
MTHNIAVKLIQKDVLLYIVAVIDVKGII

SEQ ID NO: 28096 - protein, 28 aa, artificial
  peptide fold or domain or sub-domain
MVLLYSQASWDQRSKADALVLPFWMKNS

SEQ ID NO: 28097 - protein, 16 aa, artificial
  peptide fold or domain or sub-domain
MRTPLLPWCILWVTIP

SEQ ID NO: 28098 - protein, 27 aa, artificial
  peptide fold or domain or sub-domain
MGVEKIKAAFENGKKAFIPYVVRVHCC

SEQ ID NO: 28099 - protein, 26 aa, artificial
  peptide fold or domain or sub-domain
MESEPFCVYIPKALRKQKKNVKKGHE

SEQ ID NO: 28100 - protein, 25 aa, artificial
  peptide fold or domain or sub-domain
KLTVDMVKDKSINLIDIAVWIEDFI

SEQ ID NO: 28101 - protein, 28 aa, artificial
  peptide fold or domain or sub-domain
EPVSFAKRIKQGAYIYILLSSAQIVNLI

SEQ ID NO: 28102 - protein, 30 aa, artificial
  peptide fold or domain or sub-domain
EDIDMKRITGEVNTSIPFLHMDDHANWFSK

SEQ ID NO: 28103 - protein, 30 aa, artificial
  peptide fold or domain or sub-domain
MLGSGFLGMEGGASDLGKPPPLFFMSSSRR

SEQ ID NO: 28104 - protein, 21 aa, artificial
  peptide fold or domain or sub-domain
MGRLDAAYNKNTAMLKKGMLH

SEQ ID NO: 28105 - protein, 29 aa, artificial
  peptide fold or domain or sub-domain
MGRKPVQGDRFFFELKKKIAEQKRIRLYY

SEQ ID NO: 28106 - protein, 28 aa, artificial
  peptide fold or domain or sub-domain
MLYYNKNGGGEEINSCRPLILPVKEKAA

SEQ ID NO: 28107 - protein, 25 aa, artificial
  peptide fold or domain or sub-domain
MEWEIVFVAVSLLMLGYFVFLSITD

SEQ ID NO: 28108 - protein, 27 aa, artificial
  peptide fold or domain or sub-domain
MQKYSKNEESFGTSLGDLLKAAMKDED

SEQ ID NO: 28109 - protein, 26 aa, artificial
  peptide fold or domain or sub-domain
MRQLYAIFWPGMPPVQYARGVFAVKK

SEQ ID NO: 28110 - protein, 25 aa, artificial
  peptide fold or domain or sub-domain
MFMIVMGLVVCCAAGLIISAEVGAE

SEQ ID NO: 28111 - protein, 27 aa, artificial
  peptide fold or domain or sub-domain
MLILASFLGNSVSHAFHFKAQLNIRLK

SEQ ID NO: 28112 - protein, 26 aa, artificial
  peptide fold or domain or sub-domain
MQKIQPKDGGRLRLFDWLIPEKTKEN

SEQ ID NO: 28113 - protein, 27 aa, artificial
  peptide fold or domain or sub-domain
MMIVGMLIIWGGLAASISFAVSKAKKS

SEQ ID NO: 28114 - protein, 28 aa, artificial
  peptide fold or domain or sub-domain
MALLTLCGRAAGCLFIGQAGKDEKVNQS

SEQ ID NO: 28115 - protein, 27 aa, artificial
  peptide fold or domain or sub-domain
MLSIETNQGWKLHRDRKRGSRGRLFAY

SEQ ID NO: 28116 - protein, 25 aa, artificial
  peptide fold or domain or sub-domain
MIETEWPSCRETASKYMNEDTELIV

SEQ ID NO: 28117 - protein, 27 aa, artificial
  peptide fold or domain or sub-domain
MCFVISVHKRLKADYIELKSKNVILNN

SEQ ID NO: 28118 - protein, 22 aa, artificial
  peptide fold or domain or sub-domain
MASVWEIFTENVYINIGEKEGK

SEQ ID NO: 28119 - protein, 25 aa, artificial
  peptide fold or domain or sub-domain
MIPGDFQGLEDGAGVILKNEKSPTP

SEQ ID NO: 28120 - protein, 28 aa, artificial
  peptide fold or domain or sub-domain
MDVSASAGCSTDAGTSAQQKKALLTREP

SEQ ID NO: 28121 - protein, 30 aa, artificial
  peptide fold or domain or sub-domain
MPKLSCSASIKKEQTLKGSASKYLRRYALI

SEQ ID NO: 28122 - protein, 25 aa, artificial
  peptide fold or domain or sub-domain
MAHYSCQQTEEKEGSLRPSVCLKKV

SEQ ID NO: 28123 - protein, 21 aa, artificial
  peptide fold or domain or sub-domain
MPQKAGDSGRLMELLTRTALV

SEQ ID NO: 28124 - protein, 27 aa, artificial
  peptide fold or domain or sub-domain
MIERTKKPRLFCPFVFLPSPSNETGFA

SEQ ID NO: 28125 - protein, 26 aa, artificial
  peptide fold or domain or sub-domain
MKGAAGTQAAVTFILIENLFLMTVPH

SEQ ID NO: 28126 - protein, 26 aa, artificial
  peptide fold or domain or sub-domain
MNNILPSGMPHVKSSLAAIARELFGL

SEQ ID NO: 28127 - protein, 28 aa, artificial
  peptide fold or domain or sub-domain
MEKSDNLKFGLFGSVPDKSNRKTKENPF

SEQ ID NO: 28128 - protein, 28 aa, artificial
  peptide fold or domain or sub-domain
MHVILLYPEASRGLPVSLENGGGPDIGL

SEQ ID NO: 28129 - protein, 22 aa, artificial
  peptide fold or domain or sub-domain
MHMHSFLLPSGISIIMDSMLDD

SEQ ID NO: 28130 - protein, 24 aa, artificial
  peptide fold or domain or sub-domain
MKYMSSRPHFFLLAVENGNRRREA

SEQ ID NO: 28131 - protein, 24 aa, artificial
  peptide fold or domain or sub-domain
MTAEKRQTKGLWVTRPFASSAKFI

SEQ ID NO: 28132 - protein, 29 aa, artificial
  peptide fold or domain or sub-domain
MLFWYAKKEEKGAAWNMILAFPFSIYVSN

SEQ ID NO: 28133 - protein, 28 aa, artificial
  peptide fold or domain or sub-domain
MADYGWPGKHCTGMNAFRCFFQTEWDFD

SEQ ID NO: 28134 - protein, 26 aa, artificial
  peptide fold or domain or sub-domain
MTVSIAIIFPALKNPPFLAETGDSLL

SEQ ID NO: 28135 - protein, 22 aa, artificial
  peptide fold or domain or sub-domain
MGTRRARLKPIGQSKWKTLYIG

SEQ ID NO: 28136 - protein, 29 aa, artificial
  peptide fold or domain or sub-domain
EPENENAEKPLHGPLKITRQGGGQCKSTN

SEQ ID NO: 28137 - protein, 24 aa, artificial
  peptide fold or domain or sub-domain
MWYIPAFSFEFAQAAGIFSGFLYI

SEQ ID NO: 28138 - protein, 29 aa, artificial
  peptide fold or domain or sub-domain
MAGQSYSGGVELGHMPAAGSAYILFGRLQ

SEQ ID NO: 28139 - protein, 27 aa, artificial
  peptide fold or domain or sub-domain
MIKIKLEPFLDLAWPVFGTPDRRKGQP

SEQ ID NO: 28140 - protein, 30 aa, artificial
  peptide fold or domain or sub-domain
MAVSADPAAAGYEKEAVCRIGPTAFSLVRK

SEQ ID NO: 28141 - protein, 28 aa, artificial
  peptide fold or domain or sub-domain
MRNFTKIEKNIKIEGQDAKRSCCLKEAG

SEQ ID NO: 28142 - protein, 25 aa, artificial
  peptide fold or domain or sub-domain
MKKGGPNGPPFSYANWKGNPAENTA

SEQ ID NO: 28143 - protein, 21 aa, artificial
  peptide fold or domain or sub-domain
MGMAAAIPFFIGKAEMPIYGL

SEQ ID NO: 28144 - protein, 17 aa, artificial
  peptide fold or domain or sub-domain
MFAEEKEVSFLSFLVLY

SEQ ID NO: 28145 - protein, 23 aa, artificial
  peptide fold or domain or sub-domain
MIDDPFVKGGELQPDLRAYIEKD

SEQ ID NO: 28146 - protein, 25 aa, artificial
  peptide fold or domain or sub-domain
MKDLPGRKVLLLCSFAIQEKAGRAE

SEQ ID NO: 28147 - protein, 28 aa, artificial
  peptide fold or domain or sub-domain
MLIGWLDEGSRAFHPLWWHDEPAALLSQ

SEQ ID NO: 28148 - protein, 25 aa, artificial
  peptide fold or domain or sub-domain
MEVRSFDAAVGQAGFFYELCLDGLG

SEQ ID NO: 28149 - protein, 28 aa, artificial
  peptide fold or domain or sub-domain
MLIRGGKNVENLLYPQQMEFFFLKTLQK

SEQ ID NO: 28150 - protein, 26 aa, artificial
  peptide fold or domain or sub-domain
SALLILMGALIGVWGSLMSVRKFLKV

SEQ ID NO: 28151 - protein, 25 aa, artificial
  peptide fold or domain or sub-domain
MGPLFFDIYPEGPGRMTGPSFYIMA

SEQ ID NO: 28152 - protein, 25 aa, artificial
  peptide fold or domain or sub-domain
MQDEKYLKMESAAAVLLQTIKQKIK

SEQ ID NO: 28153 - protein, 25 aa, artificial
  peptide fold or domain or sub-domain
MVPVYKDGSSAPAAADTEIYGGDLP

SEQ ID NO: 28154 - protein, 21 aa, artificial
  peptide fold or domain or sub-domain
MQINFCRGGNYEEAEHIESID

SEQ ID NO: 28155 - protein, 28 aa, artificial
  peptide fold or domain or sub-domain
MWKEFVNSISKEYHFKDPATKFEIAQIQ

SEQ ID NO: 28156 - protein, 23 aa, artificial
  peptide fold or domain or sub-domain
MKLAYMPSAAEEAPFLLFFRGLC

SEQ ID NO: 28157 - protein, 24 aa, artificial
  peptide fold or domain or sub-domain
MYDILHPFSDKGKNFLMLFLKRLQ

SEQ ID NO: 28158 - protein, 28 aa, artificial
  peptide fold or domain or sub-domain
MGRVNSYQFDIILPAPTNLNLDMLEQAE

SEQ ID NO: 28159 - protein, 28 aa, artificial
  peptide fold or domain or sub-domain
MFDLPDLCKEGSNSDGPFRMAKVLVTDV

SEQ ID NO: 28160 - protein, 26 aa, artificial
  peptide fold or domain or sub-domain
MKKDEEIMGLMTLSSGAGTAGAVLKY

SEQ ID NO: 28161 - protein, 29 aa, artificial
  peptide fold or domain or sub-domain
MRNAAALADPAPQHAVFEDAPRKGEKERC

SEQ ID NO: 28162 - protein, 26 aa, artificial
  peptide fold or domain or sub-domain
MIKTSKFIIRVLAAGNQGKEKQNASI

SEQ ID NO: 28163 - protein, 22 aa, artificial
  peptide fold or domain or sub-domain
MSGDIYKFFYVGAAIFSMRKSL

SEQ ID NO: 28164 - protein, 23 aa, artificial
  peptide fold or domain or sub-domain
MERTGLLAGPFHAALDEPEFYKY

SEQ ID NO: 28165 - protein, 25 aa, artificial
  peptide fold or domain or sub-domain
MVFGDGMEAGHPLLIGLFKKAFFYS

SEQ ID NO: 28166 - protein, 27 aa, artificial
  peptide fold or domain or sub-domain
MEVFAVTLSIASIMVIGYFIGCALVHN

SEQ ID NO: 28167 - protein, 25 aa, artificial
  peptide fold or domain or sub-domain
MHLFYGFLFYFPPAAKVKLLFPAEN

SEQ ID NO: 28168 - protein, 23 aa, artificial
  peptide fold or domain or sub-domain
MKGEEFMSREEIIKLTSLSTKGG

SEQ ID NO: 28169 - protein, 28 aa, artificial
  peptide fold or domain or sub-domain
MVADRAQLLSDFRLSYVMIAEKLQIIGR

SEQ ID NO: 28170 - protein, 24 aa, artificial
  peptide fold or domain or sub-domain
MYLGKRGFQPDALESSFYLIGKHN

SEQ ID NO: 28171 - protein, 27 aa, artificial
  peptide fold or domain or sub-domain
MKKAGIISEEEYQKIIEGCCGGKRSSS

SEQ ID NO: 28172 - protein, 27 aa, artificial
  peptide fold or domain or sub-domain
MRFRRSTAAAVLFVFRKESRSKKMPAR

SEQ ID NO: 28173 - protein, 30 aa, artificial
  peptide fold or domain or sub-domain
MMIKYELKSIQHAGWIFGWGRRDRLIFKRA

SEQ ID NO: 28174 - protein, 23 aa, artificial
  peptide fold or domain or sub-domain
MAMIISLNYAIKKGHRNQPKEIE

SEQ ID NO: 28175 - protein, 26 aa, artificial
  peptide fold or domain or sub-domain
MEIAKKEPQGQVPWLNFERAAALCSS

SEQ ID NO: 28176 - protein, 26 aa, artificial
  peptide fold or domain or sub-domain
MKTGSCAGLAYRTEGQVSHVSVPLFF

SEQ ID NO: 28177 - protein, 21 aa, artificial
  peptide fold or domain or sub-domain
MLHPPFYFILNQKEDDGKYYL

SEQ ID NO: 28178 - protein, 29 aa, artificial
  peptide fold or domain or sub-domain
MNLLLILLAMLSSAGFLYYWGQIEGSDDQ

SEQ ID NO: 28179 - protein, 24 aa, artificial
  peptide fold or domain or sub-domain
MITYIYMVSMESRQKKMKMKDQEG

SEQ ID NO: 28180 - protein, 25 aa, artificial
  peptide fold or domain or sub-domain
MLMQPAVQDILLIDHHEADKEPTSK

SEQ ID NO: 28181 - protein, 28 aa, artificial
  peptide fold or domain or sub-domain
MSYKSCQKALKTLSWNGIYEVTAAKTAI

SEQ ID NO: 28182 - protein, 24 aa, artificial
  peptide fold or domain or sub-domain
MSPKSTTKFNNAIIKKSRILLIEK

SEQ ID NO: 28183 - protein, 29 aa, artificial
  peptide fold or domain or sub-domain
MALGYHVSLIMGVAFETQAAYLMEKRVDV

SEQ ID NO: 28184 - protein, 30 aa, artificial
  peptide fold or domain or sub-domain
MLDHKQQVDLKIGIFLYVVILPKGNEPTKG

SEQ ID NO: 28185 - protein, 28 aa, artificial
  peptide fold or domain or sub-domain
MKTKKQAERTYPACFFYLTDRMWKHEEK

SEQ ID NO: 28186 - protein, 26 aa, artificial
  peptide fold or domain or sub-domain
MAEDWTAAQQKAVLIGRIVMLMSIKS

SEQ ID NO: 28187 - protein, 25 aa, artificial
  peptide fold or domain or sub-domain
YYDALIIGSGAAGLSMALHLQKKQK

SEQ ID NO: 28188 - protein, 28 aa, artificial
  peptide fold or domain or sub-domain
KKGVITDSNTTTSDTKKPAMEARAGLKG

SEQ ID NO: 28189 - protein, 21 aa, artificial
  peptide fold or domain or sub-domain
MLGMDNGTTKNNDLFKGEQRE

SEQ ID NO: 28190 - protein, 27 aa, artificial
  peptide fold or domain or sub-domain
FSDKYRGGMIAARYGLSRPWLFPAEFS

SEQ ID NO: 28191 - protein, 28 aa, artificial
  peptide fold or domain or sub-domain
ATVKGLAAMKSPEDVAAKRGKSVEDILG

SEQ ID NO: 28192 - protein, 30 aa, artificial
  peptide fold or domain or sub-domain
MFEFTEHDIFLLDVTVEKKQEGHSNHSACA

SEQ ID NO: 28193 - protein, 25 aa, artificial
  peptide fold or domain or sub-domain
MLNQNKETPAPQDDEEGSVYILSDN

SEQ ID NO: 28194 - protein, 26 aa, artificial
  peptide fold or domain or sub-domain
MLNSELTLKFMIVNRGYGSINLLMMI

SEQ ID NO: 28195 - protein, 30 aa, artificial
  peptide fold or domain or sub-domain
MIKMKVLTHRISAISEEKVMYSQGEKIVLK

SEQ ID NO: 28196 - protein, 30 aa, artificial
  peptide fold or domain or sub-domain
MVDRPFFWLNKGSNNENNADLVWMCFRARY

SEQ ID NO: 28197 - protein, 25 aa, artificial
  peptide fold or domain or sub-domain
MSRIINKIVSLYIPVFASMYQAQIK

SEQ ID NO: 28198 - protein, 24 aa, artificial
  peptide fold or domain or sub-domain
MARLHNVTTLNRVEMKKGLAIKNR

SEQ ID NO: 28199 - protein, 28 aa, artificial
  peptide fold or domain or sub-domain
MNQKAIKRFWSRANRELVAKMISEFDYE

SEQ ID NO: 28200 - protein, 25 aa, artificial
  peptide fold or domain or sub-domain
MHQIGASECNLFIADRALLIGETVD

SEQ ID NO: 28201 - protein, 28 aa, artificial
  peptide fold or domain or sub-domain
MVKLIEHSPYIPHKLALYLSWPQAAGAN

SEQ ID NO: 28202 - protein, 25 aa, artificial
  peptide fold or domain or sub-domain
MKKADEGCPPSADILTIEACLHLNL

SEQ ID NO: 28203 - protein, 28 aa, artificial
  peptide fold or domain or sub-domain
MFLVPSLQQYAGRGTTNMRNGRDPDAKP

SEQ ID NO: 28204 - protein, 30 aa, artificial
  peptide fold or domain or sub-domain
MRIPEERGFIYASSIFTAGLVLLVSITVIL

SEQ ID NO: 28205 - protein, 29 aa, artificial
  peptide fold or domain or sub-domain
MLQKAILLSESAYELFANIIVSDLVAGTV

SEQ ID NO: 28206 - protein, 30 aa, artificial
  peptide fold or domain or sub-domain
MVYSAYFGGCDGRDAEHVVPLLYWAMTSGD

SEQ ID NO: 28207 - protein, 22 aa, artificial
  peptide fold or domain or sub-domain
MHAIIYLIGLVVIVLAILNFVA

SEQ ID NO: 28208 - protein, 27 aa, artificial
  peptide fold or domain or sub-domain
MGASAFSIALSEIFSLTLTAPIGIVPL

SEQ ID NO: 28209 - protein, 26 aa, artificial
  peptide fold or domain or sub-domain
MATDTSGVDPPKVKLPGLRLLDASMV

SEQ ID NO: 28210 - protein, 29 aa, artificial
  peptide fold or domain or sub-domain
MLARQAAHSMSSWTAANLARRTDIAIRMP

SEQ ID NO: 28211 - protein, 30 aa, artificial
  peptide fold or domain or sub-domain
MMPPMTAARHILASAIPGARPLGLLLLTRL

SEQ ID NO: 28212 - protein, 21 aa, artificial
  peptide fold or domain or sub-domain
MSIPRSVMVGPFLLTILFTMW

SEQ ID NO: 28213 - protein, 26 aa, artificial
  peptide fold or domain or sub-domain
MIATDEGMIRQLDLAQVLPTALEEPA

SEQ ID NO: 28214 - protein, 30 aa, artificial
  peptide fold or domain or sub-domain
MNACKSGYGTVLFFEDSKVVEGLQEQFASY

SEQ ID NO: 28215 - protein, 30 aa, artificial
  peptide fold or domain or sub-domain
MMEERGLFIAHTTIMRWIHQYGSELVFTSM

SEQ ID NO: 28216 - protein, 24 aa, artificial
  peptide fold or domain or sub-domain
CRHSGISDCLQIDFLLHDCSYHGW

SEQ ID NO: 28217 - protein, 26 aa, artificial
  peptide fold or domain or sub-domain
CRHRGSHVNIRFSIARFCCSCTYHGW

SEQ ID NO: 28218 - protein, 25 aa, artificial
  peptide fold or domain or sub-domain
CRHRGASLALARNEETGLRCTYHGW

SEQ ID NO: 28219 - protein, 30 aa, artificial
  peptide fold or domain or sub-domain
MSVINAYSNASLLFFIYLLFIMYQISLSVK

SEQ ID NO: 28220 - protein, 30 aa, artificial
  peptide fold or domain or sub-domain
MTKKRRYDTTEFGLAHSMTAKITLHQALYK

SEQ ID NO: 28221 - protein, 30 aa, artificial
  peptide fold or domain or sub-domain
MELESLRELASEATKEDKYQVYDVILAGVK

SEQ ID NO: 28222 - protein, 30 aa, artificial
  peptide fold or domain or sub-domain
MFIFKTTSKSHFHNNVKSLECIKIPINKNR

SEQ ID NO: 28223 - protein, 30 aa, artificial
  peptide fold or domain or sub-domain
MLKSKFPSPLSTVDISFFEIIYIFSYQDIL

SEQ ID NO: 28224 - protein, 30 aa, artificial
  peptide fold or domain or sub-domain
MTKNTIISLENEKTQINDSENESSDLRKAK

SEQ ID NO: 28225 - protein, 30 aa, artificial
  peptide fold or domain or sub-domain
MKIILLLFLIFGFIVVVTLKSEHQLTLFSI

SEQ ID NO: 28226 - protein, 30 aa, artificial
  peptide fold or domain or sub-domain
MQRLLSNMGHTDGLFFKLLHYAFSMNQIAI

SEQ ID NO: 28227 - protein, 30 aa, artificial
  peptide fold or domain or sub-domain
MAVVNEMTLMIMLKSFLYFCLIFNQIDISH

SEQ ID NO: 28228 - protein, 30 aa, artificial
  peptide fold or domain or sub-domain
MLKTVKSTRLLGIKKHTELNSCTPNVRKQC

SEQ ID NO: 28229 - protein, 30 aa, artificial
  peptide fold or domain or sub-domain
MVNDKVLETSKEMYVEQKCLIFYKTLKENV

SEQ ID NO: 28230 - protein, 30 aa, artificial
  peptide fold or domain or sub-domain
MESIFKIKLMNGICRSENMNMKKKNKGEKI

SEQ ID NO: 28231 - protein, 30 aa, artificial
  peptide fold or domain or sub-domain
MTKNSKYTNEVSKEQFQEIENVNNKVKEFY

SEQ ID NO: 28232 - protein, 30 aa, artificial
  peptide fold or domain or sub-domain
MFCYYKQHKGDNFSIEEVKNIIADNEMKVN

SEQ ID NO: 28233 - protein, 30 aa, artificial
  peptide fold or domain or sub-domain
MFDFSTILKRKFVTGWWGHNIEKAVRDFLN

SEQ ID NO: 28234 - protein, 30 aa, artificial
  peptide fold or domain or sub-domain
MQPSFRIEILTWEAQILLDLIDDQILYRTP

SEQ ID NO: 28235 - protein, 28 aa, artificial
  peptide fold or domain or sub-domain
MIRDALVHCRKVTAERQGDNLANLSARR

SEQ ID NO: 28236 - protein, 28 aa, artificial
  peptide fold or domain or sub-domain
MTKRVTNFAEFGHPQSDQAETQDESQGL

SEQ ID NO: 28237 - protein, 27 aa, artificial
  peptide fold or domain or sub-domain
MDLSGESQQSRFYRRNNVSDERLMATD

SEQ ID NO: 28238 - protein, 30 aa, artificial
  peptide fold or domain or sub-domain
MRLIFLGALFTTRCFLIYLTGCAFTDLADL

SEQ ID NO: 28239 - protein, 24 aa, artificial
  peptide fold or domain or sub-domain
MTILFGLGAAAIFGRRKWMIKKAA

SEQ ID NO: 28240 - protein, 25 aa, artificial
  peptide fold or domain or sub-domain
MLFDFVQMEISISIQTRLEQWLAHT

SEQ ID NO: 28241 - protein, 29 aa, artificial
  peptide fold or domain or sub-domain
MEFKLMEIESHLEELAWSLDEVVDDLTER

SEQ ID NO: 28242 - protein, 30 aa, artificial
  peptide fold or domain or sub-domain
MFTVRKVGRARVIIQFVHENRAEASLLESK

SEQ ID NO: 28243 - protein, 28 aa, artificial
  peptide fold or domain or sub-domain
RAQVEALTRNSAGTPECPMPGIPTEPAA

SEQ ID NO: 28244 - protein, 18 aa, artificial
  peptide fold or domain or sub-domain
MLVTRFKKALISYFLGAL

SEQ ID NO: 28245 - protein, 30 aa, artificial
  peptide fold or domain or sub-domain
MDEEIKRLAQQMAESQDRTVSDACRELMEI

SEQ ID NO: 28246 - protein, 15 aa, artificial
  peptide fold or domain or sub-domain
VNVNEFTVGPTSQPW

SEQ ID NO: 28247 - protein, 17 aa, artificial
  peptide fold or domain or sub-domain
MKGWLFLVIAIVAKYRT

SEQ ID NO: 28248 - protein, 27 aa, artificial
  peptide fold or domain or sub-domain
MLGILIWVMNSLVPSEEKETSVAGGAN

SEQ ID NO: 28249 - protein, 23 aa, artificial
  peptide fold or domain or sub-domain
MNWDLSSIAPSPVATVNEFFVLA

SEQ ID NO: 28250 - protein, 28 aa, artificial
  peptide fold or domain or sub-domain
MFPHRVDDVLEHYLGSCYPHHVDDALDI

SEQ ID NO: 28251 - protein, 30 aa, artificial
  peptide fold or domain or sub-domain
FETIRTTKDLQEEAELDAAIQAFKDQSQFK

SEQ ID NO: 28252 - protein, 26 aa, artificial
  peptide fold or domain or sub-domain
MVFSFPKFYRGFREDPNQVFDQVGKI

SEQ ID NO: 28253 - protein, 30 aa, artificial
  peptide fold or domain or sub-domain
MIFKRRFQLTWVSGITIITLYPLAFSYPSQ

SEQ ID NO: 28254 - protein, 28 aa, artificial
  peptide fold or domain or sub-domain
RGEPVKMSSQSYDTGSPAQIESSQTLRK

SEQ ID NO: 28255 - protein, 25 aa, artificial
  peptide fold or domain or sub-domain
RVTISNVELAKSTRKIISHVTIMYL

SEQ ID NO: 28256 - protein, 30 aa, artificial
  peptide fold or domain or sub-domain
MEEVIWNLVKEFGYENPKNGFGIIKKRKIR

SEQ ID NO: 28257 - protein, 22 aa, artificial
  peptide fold or domain or sub-domain
MPEAISSLNFKVLLHYFEDDIN

SEQ ID NO: 28258 - protein, 30 aa, artificial
  peptide fold or domain or sub-domain
MHKTSKGIDIIGSLDYTIWYQMLQILEVIL

SEQ ID NO: 28259 - protein, 30 aa, artificial
  peptide fold or domain or sub-domain
MGNGIVGRKLFKLIFIWIYFFKQFIFYKVH

SEQ ID NO: 28260 - protein, 24 aa, artificial
  peptide fold or domain or sub-domain
MTPKPVPDKDNMIPQGGKTQYPKG

SEQ ID NO: 28261 - protein, 29 aa, artificial
  peptide fold or domain or sub-domain
MVPIFTKGEKVRIPAGEPVLSNRVCKEKK

SEQ ID NO: 28262 - protein, 23 aa, artificial
  peptide fold or domain or sub-domain
MSRHRTYSMISHGADYIFILSVT

SEQ ID NO: 28263 - protein, 27 aa, artificial
  peptide fold or domain or sub-domain
MGGDIPEGSLFYGYSRLILRILWVIFF

SEQ ID NO: 28264 - protein, 27 aa, artificial
  peptide fold or domain or sub-domain
EIISDDVSIDGAAVAMQRGIWHISPAH

SEQ ID NO: 28265 - protein, 25 aa, artificial
  peptide fold or domain or sub-domain
QSMVVNNYIAKHELEGWKIVKNDKT

SEQ ID NO: 28266 - protein, 30 aa, artificial
  peptide fold or domain or sub-domain
MIDQVLIVGFDSLSSVMKQWHKNPPFHLSK

SEQ ID NO: 28267 - protein, 30 aa, artificial
  peptide fold or domain or sub-domain
MSNQKKAYPDIHSQRIDISYYQQGIEDMTQ

SEQ ID NO: 28268 - protein, 30 aa, artificial
  peptide fold or domain or sub-domain
MIIDGRMMWNHLPEKINRLMGYRTTLSMKK

SEQ ID NO: 28269 - protein, 24 aa, artificial
  peptide fold or domain or sub-domain
MIIGVMGGRSNPITHVKNSYKKEW

SEQ ID NO: 28270 - protein, 27 aa, artificial
  peptide fold or domain or sub-domain
KNNIFSKIYSNFNGISLSLSIVLLQDK

SEQ ID NO: 28271 - protein, 24 aa, artificial
  peptide fold or domain or sub-domain
MKHELSSAMIKGTRFFEDEVCGLM

SEQ ID NO: 28272 - protein, 26 aa, artificial
  peptide fold or domain or sub-domain
MSRVRDPDHELVVKIITASMDDLITR

SEQ ID NO: 28273 - protein, 30 aa, artificial
  peptide fold or domain or sub-domain
MNFRERFLLTRGVMPKLEWHREPYISKGLP

SEQ ID NO: 28274 - protein, 30 aa, artificial
  peptide fold or domain or sub-domain
MAASDILLMGLGELKTRADNLISEATIMAK

SEQ ID NO: 28275 - protein, 22 aa, artificial
  peptide fold or domain or sub-domain
MSIFLLSNMVDYTGHIYTSRFP

SEQ ID NO: 28276 - protein, 27 aa, artificial
  peptide fold or domain or sub-domain
MVEQWIEAPCVGRSIPSRAIYTLGEIA

SEQ ID NO: 28277 - protein, 25 aa, artificial
  peptide fold or domain or sub-domain
MGFLKRGQLLDIVQKAVNDANPKMP

SEQ ID NO: 28278 - protein, 26 aa, artificial
  peptide fold or domain or sub-domain
MVSVYQKATFKPHSRGKNEAPISHHL

SEQ ID NO: 28279 - protein, 27 aa, artificial
  peptide fold or domain or sub-domain
MTTLLVIQMVKGITSFNGLKYILVLDS

SEQ ID NO: 28280 - protein, 25 aa, artificial
  peptide fold or domain or sub-domain
MGFADLSHPAIITKLTTIAMRKKTF

SEQ ID NO: 28281 - protein, 29 aa, artificial
  peptide fold or domain or sub-domain
MTLNIASKQMDITPAIRSHIEERLAKLEN

SEQ ID NO: 28282 - protein, 27 aa, artificial
  peptide fold or domain or sub-domain
MKIGVLGLQGAVREHVNQLSKWCEAVV

SEQ ID NO: 28283 - protein, 23 aa, artificial
  peptide fold or domain or sub-domain
MTSIENECIFDSGKVFLPRPTFE

SEQ ID NO: 28284 - protein, 24 aa, artificial
  peptide fold or domain or sub-domain
MIYLHEQRHIGRIKEIKLPCEIEK

SEQ ID NO: 28285 - protein, 30 aa, artificial
  peptide fold or domain or sub-domain
MYQVDYKESEFTSMSFNLQNKENNPPWGTD

SEQ ID NO: 28286 - protein, 28 aa, artificial
  peptide fold or domain or sub-domain
MQDEAFQKELNHYLKTYVGREPAYFAEI

SEQ ID NO: 28287 - protein, 22 aa, artificial
  peptide fold or domain or sub-domain
MIKCLWFFYCTNTESVHLYESF

SEQ ID NO: 28288 - protein, 29 aa, artificial
  peptide fold or domain or sub-domain
MDDGIEKERKQFLENHIDINEINSVLRDK

SEQ ID NO: 28289 - protein, 29 aa, artificial
  peptide fold or domain or sub-domain
MKRNPLIPFALIAALGIIVMFVFSFSGAK

SEQ ID NO: 28290 - protein, 28 aa, artificial
  peptide fold or domain or sub-domain
MVKTVTVLARDKSGELGFKIITSYPSDK

SEQ ID NO: 28291 - protein, 25 aa, artificial
  peptide fold or domain or sub-domain
MHWVHQYGPQVVEKVRCHLKSTNDS

SEQ ID NO: 28292 - protein, 25 aa, artificial
  peptide fold or domain or sub-domain
MISMEKENLFKWEHYQPELILLTVR

SEQ ID NO: 28293 - protein, 28 aa, artificial
  peptide fold or domain or sub-domain
MSIYKGPIVDGHHHFWEPSLGKQPWLLP

SEQ ID NO: 28294 - protein, 22 aa, artificial
  peptide fold or domain or sub-domain
MQHKTKNKLLIIFTDFYLFVVC

SEQ ID NO: 28295 - protein, 21 aa, artificial
  peptide fold or domain or sub-domain
NREIYFKSAFFDVLFISYFEL

SEQ ID NO: 28296 - protein, 25 aa, artificial
  peptide fold or domain or sub-domain
MIVFQITTYFNPHLNDLCFFEEKNS

SEQ ID NO: 28297 - protein, 21 aa, artificial
  peptide fold or domain or sub-domain
MTHIYSYSPHFPSFRQQITRN

SEQ ID NO: 28298 - protein, 25 aa, artificial
  peptide fold or domain or sub-domain
SFFLWHNKLPETDYIIDHLNKNFNI

SEQ ID NO: 28299 - protein, 24 aa, artificial
  peptide fold or domain or sub-domain
YRCCFLVEDIQTYILYFLSNILNS

SEQ ID NO: 28300 - protein, 22 aa, artificial
  peptide fold or domain or sub-domain
NEKVVSLLPASALPDSCSPAPP

SEQ ID NO: 28301 - protein, 16 aa, artificial
  peptide fold or domain or sub-domain
MEKKIGYTTVDISQWH

SEQ ID NO: 28302 - protein, 25 aa, artificial
  peptide fold or domain or sub-domain
MSAPFSVSVAPSGGCFLFLLYFWVH

SEQ ID NO: 28303 - protein, 16 aa, artificial
  peptide fold or domain or sub-domain
MCKGQSVYFGVTPYIF

SEQ ID NO: 28304 - protein, 25 aa, artificial
  peptide fold or domain or sub-domain
MIAIYSRVSTEEQAIKGSSIDSQIE

SEQ ID NO: 28305 - protein, 26 aa, artificial
  peptide fold or domain or sub-domain
MISLIGAFSFSCFRIENMYLACFFPN

SEQ ID NO: 28306 - protein, 30 aa, artificial
  peptide fold or domain or sub-domain
MERQNVQQQRGKDQRPQRPGASNPRRPNQR

SEQ ID NO: 28307 - protein, 21 aa, artificial
  peptide fold or domain or sub-domain
FQSAILLTGPDGRTGKRVTQR

SEQ ID NO: 28308 - protein, 17 aa, artificial
  peptide fold or domain or sub-domain
MKTPLTEAVTAADTQGP

SEQ ID NO: 28309 - protein, 19 aa, artificial
  peptide fold or domain or sub-domain
MGTFSIFVINNNQIKINWL

SEQ ID NO: 28310 - protein, 15 aa, artificial
  peptide fold or domain or sub-domain
MCTSIAVVEITLSHS

SEQ ID NO: 28311 - protein, 21 aa, artificial
  peptide fold or domain or sub-domain
MLDDGSVKALKSKLLEVKYLK

SEQ ID NO: 28312 - protein, 15 aa, artificial
  peptide fold or domain or sub-domain
MRKTMIVLMERPFAG

SEQ ID NO: 28313 - protein, 29 aa, artificial
  peptide fold or domain or sub-domain
MNIIIICAIIGGLMGYFYMNRKLEKKTNN

SEQ ID NO: 28314 - protein, 27 aa, artificial
  peptide fold or domain or sub-domain
MIYIFKYEDYEKQTNFLRNTRMVMING

SEQ ID NO: 28315 - protein, 26 aa, artificial
  peptide fold or domain or sub-domain
MDSRCGEVALPASAIFNICFNVALTT

SEQ ID NO: 28316 - protein, 19 aa, artificial
  peptide fold or domain or sub-domain
MTGLLLHSQAKPDITREYW

SEQ ID NO: 28317 - protein, 18 aa, artificial
  peptide fold or domain or sub-domain
MHCQNQNRIPSSPKCELE

SEQ ID NO: 28318 - protein, 18 aa, artificial
  peptide fold or domain or sub-domain
EFQLSAGRYHYQVMLPTY

SEQ ID NO: 28319 - protein, 26 aa, artificial
  peptide fold or domain or sub-domain
RLHFPHLFPLDYQDLPHSCLTVKLCV

SEQ ID NO: 28320 - protein, 26 aa, artificial
  peptide fold or domain or sub-domain
MCLSFVPLFCTKNIVLRITFFDFAYL

SEQ ID NO: 28321 - protein, 11 aa, artificial
  peptide fold or domain or sub-domain
MRPAKQQNGDA

SEQ ID NO: 28322 - protein, 22 aa, artificial
  peptide fold or domain or sub-domain
MSAGNNTNVDRVSLLASYIQDA

SEQ ID NO: 28323 - protein, 19 aa, artificial
  peptide fold or domain or sub-domain
SHGYRYLESRACVDPGGSQ

SEQ ID NO: 28324 - protein, 20 aa, artificial
  peptide fold or domain or sub-domain
MTTAVPFRLTMNRGILFYLA

SEQ ID NO: 28325 - protein, 14 aa, artificial
  peptide fold or domain or sub-domain
LKEVIMEKKHESSF

SEQ ID NO: 28326 - protein, 16 aa, artificial
  peptide fold or domain or sub-domain
ISILMMEHENESPRSK

SEQ ID NO: 28327 - protein, 29 aa, artificial
  peptide fold or domain or sub-domain
MCRSAQNRFYRHERLWLRISAHLSPILHE

SEQ ID NO: 28328 - protein, 26 aa, artificial
  peptide fold or domain or sub-domain
MNITHCKLKKFMQNKLLEFFVLEITA

SEQ ID NO: 28329 - protein, 27 aa, artificial
  peptide fold or domain or sub-domain
MVIYHNHKRKNYRISPFSYSNFLYIRI

SEQ ID NO: 28330 - protein, 29 aa, artificial
  peptide fold or domain or sub-domain
MVRLVRGKFWAWFNSGAYYWWFCRRDFTA

SEQ ID NO: 28331 - protein, 21 aa, artificial
  peptide fold or domain or sub-domain
MSAEHVLTMLNEHEVKFVGDP

SEQ ID NO: 28332 - protein, 27 aa, artificial
  peptide fold or domain or sub-domain
MKLSFLHNYEVTTLAKAIYSITSWFPN

SEQ ID NO: 28333 - protein, 25 aa, artificial
  peptide fold or domain or sub-domain
VAINSLINATPLNSYGDLNNASFSK

SEQ ID NO: 28334 - protein, 23 aa, artificial
  peptide fold or domain or sub-domain
ILLKAAGAIKNQLSNCAKLNIVT

SEQ ID NO: 28335 - protein, 20 aa, artificial
  peptide fold or domain or sub-domain
YGYKAYYVMKTLFKVSFLCV

SEQ ID NO: 28336 - protein, 29 aa, artificial
  peptide fold or domain or sub-domain
MVVFCRPKEERGSYQQWKEDNIAPQVVFE

SEQ ID NO: 28337 - protein, 25 aa, artificial
  peptide fold or domain or sub-domain
MIFSCTEEAFYSANKRSNNNKTCSQ

SEQ ID NO: 28338 - protein, 29 aa, artificial
  peptide fold or domain or sub-domain
MGFQRAGLLAIQNLAIIAASDLSVLFLSS

SEQ ID NO: 28339 - protein, 27 aa, artificial
  peptide fold or domain or sub-domain
MEFGMKTQYLPTKVMYVVNEAPLLPRS

SEQ ID NO: 28340 - protein, 25 aa, artificial
  peptide fold or domain or sub-domain
MAKLAPLVAQLILGSNYRIPGISYI

SEQ ID NO: 28341 - protein, 30 aa, artificial
  peptide fold or domain or sub-domain
MGIFIALKMANTAADFSALASLSKALHNER

SEQ ID NO: 28342 - protein, 30 aa, artificial
  peptide fold or domain or sub-domain
MSITDAPCGSYHLEININWIGKNFNGLILN

SEQ ID NO: 28343 - protein, 30 aa, artificial
  peptide fold or domain or sub-domain
ANSSIAIAQCDINGNFVKKKYGTNKACRVR

SEQ ID NO: 28344 - protein, 30 aa, artificial
  peptide fold or domain or sub-domain
KIIKGIINSKTSFILRLVEYKKVFTSIGTK

SEQ ID NO: 28345 - protein, 26 aa, artificial
  peptide fold or domain or sub-domain
GAYWRGDAKGPMCSDIWYSMEEIRMN

SEQ ID NO: 28346 - protein, 30 aa, artificial
  peptide fold or domain or sub-domain
MPDISDISKVASSQKLSTRAIKKKDQSSQF

SEQ ID NO: 28347 - protein, 26 aa, artificial
  peptide fold or domain or sub-domain
MLCGEYSAVKMCRIPNLVNIASNSFA

SEQ ID NO: 28348 - protein, 25 aa, artificial
  peptide fold or domain or sub-domain
MRISSVIWSQQIICNRCLNGVINYS

SEQ ID NO: 28349 - protein, 28 aa, artificial
  peptide fold or domain or sub-domain
ISVGSISIVNIELLQMQKNVSSRSNRDK

SEQ ID NO: 28350 - protein, 27 aa, artificial
  peptide fold or domain or sub-domain
MINSIMRSIPPANPIAGVCFPPTEDTK

SEQ ID NO: 28351 - protein, 24 aa, artificial
  peptide fold or domain or sub-domain
MKKLLKNIGRFRISGNSTAIRKIT

SEQ ID NO: 28352 - protein, 30 aa, artificial
  peptide fold or domain or sub-domain
MQPAWLKLSLLDPSSQGTGMTITLTISKEA

SEQ ID NO: 28353 - protein, 30 aa, artificial
  peptide fold or domain or sub-domain
MSVSVQQSGKIGRQDKPKNREKVSLQQLVS

SEQ ID NO: 28354 - protein, 30 aa, artificial
  peptide fold or domain or sub-domain
MNIYAKFVFSHKISYKLIKINNIKKIIEFA

SEQ ID NO: 28355 - protein, 27 aa, artificial
  peptide fold or domain or sub-domain
MQYLYLFRCMANAETKIPVLPFLSSQC

SEQ ID NO: 28356 - protein, 30 aa, artificial
  peptide fold or domain or sub-domain
MTKGKNLGIFINVADADKTLSQQKKLTFEN

SEQ ID NO: 28357 - protein, 30 aa, artificial
  peptide fold or domain or sub-domain
MASFSRSRDFVGSFSKQLFASGCLENELAY

SEQ ID NO: 28358 - protein, 30 aa, artificial
  peptide fold or domain or sub-domain
MFLWQILLKLVQVITNLIENEELLYKIVKN

SEQ ID NO: 28359 - protein, 30 aa, artificial
  peptide fold or domain or sub-domain
MNKNVKTGISIFIIGILFFYENSSWKVLEL

SEQ ID NO: 28360 - protein, 30 aa, artificial
  peptide fold or domain or sub-domain
MELCQEGFPLLFYSENIVKNVSRETFEKAA

SEQ ID NO: 28361 - protein, 30 aa, artificial
  peptide fold or domain or sub-domain
MIGISNKQMILLTHIGDEKIAYKQHTYAKG

SEQ ID NO: 28362 - protein, 30 aa, artificial
  peptide fold or domain or sub-domain
MAGSPSFFLRNQKALTKEEEKYCIKQPEKW

SEQ ID NO: 28363 - protein, 30 aa, artificial
  peptide fold or domain or sub-domain
MEGMTNNEKVGSIRSSKRRGSRGNHQQISK

SEQ ID NO: 28364 - protein, 30 aa, artificial
  peptide fold or domain or sub-domain
MKSDLGELHPDNVAKSNTKMVAAIIAFFIF

SEQ ID NO: 28365 - protein, 30 aa, artificial
  peptide fold or domain or sub-domain
MTTPMKDVKVENYNKNFLINFFNEIMIKNL

SEQ ID NO: 28366 - protein, 30 aa, artificial
  peptide fold or domain or sub-domain
MQTQDKNNKKIIPIETYRLAFYILGLQTLY

SEQ ID NO: 28367 - protein, 30 aa, artificial
  peptide fold or domain or sub-domain
MIFYEELKQKIARILKIIYKKKLENGIQKI

SEQ ID NO: 28368 - protein, 30 aa, artificial
  peptide fold or domain or sub-domain
MLILNKGALNENHNDNSKLIFFSIFKCMCF

SEQ ID NO: 28369 - protein, 30 aa, artificial
  peptide fold or domain or sub-domain
MKVDCDFIKTLFYCQVFKIKECFLLVVIKF

SEQ ID NO: 28370 - protein, 30 aa, artificial
  peptide fold or domain or sub-domain
MLEILSIFQVVYPPFILKLIPFFTKNQIKI

SEQ ID NO: 28371 - protein, 30 aa, artificial
  peptide fold or domain or sub-domain
MLKNLTIFELLHRKQCFATRKTLSKNSKKK

SEQ ID NO: 28372 - protein, 30 aa, artificial
  peptide fold or domain or sub-domain
MYSYILSALLTICLIIAFAKAWEAYKKRGA

SEQ ID NO: 28373 - protein, 30 aa, artificial
  peptide fold or domain or sub-domain
MSEAGFILLFLIGLIMGFILRNIREGNRWI

SEQ ID NO: 28374 - protein, 30 aa, artificial
  peptide fold or domain or sub-domain
MYERYEEKEVRKHYPKLRARFAFLQNFYAY

SEQ ID NO: 28375 - protein, 30 aa, artificial
  peptide fold or domain or sub-domain
MKWKIYKYYLNFIVNSETLSLMINARAKKL

SEQ ID NO: 28376 - protein, 30 aa, artificial
  peptide fold or domain or sub-domain
MAYFLVDEALGVGMNNIGFVTGRGKRLGCK

SEQ ID NO: 28377 - protein, 30 aa, artificial
  peptide fold or domain or sub-domain
MKQNLVYYTKNLALKSKKTLIKLILATIIK

SEQ ID NO: 28378 - protein, 30 aa, artificial
  peptide fold or domain or sub-domain
MLVEFFKFLSSFFLVMAMSALRLQVDLKAF

SEQ ID NO: 28379 - protein, 29 aa, artificial
  peptide fold or domain or sub-domain
MNVYDTPDMIRRLKERYRLCDGSDLQAGS

SEQ ID NO: 28380 - protein, 30 aa, artificial
  peptide fold or domain or sub-domain
MFYGNSYGGEKRNKEILVNERGRNYGDYSV

SEQ ID NO: 28381 - protein, 30 aa, artificial
  peptide fold or domain or sub-domain
MLSHDIGTKQSAVTNDNFISPFRGTLLYHA

SEQ ID NO: 28382 - protein, 30 aa, artificial
  peptide fold or domain or sub-domain
MSIYVKETLRQVSFTFVLFIFRSIYIEEIF

SEQ ID NO: 28383 - protein, 30 aa, artificial
  peptide fold or domain or sub-domain
MNILLVECPFLAKSMNVKEKLYTTGKTTLL

SEQ ID NO: 28384 - protein, 30 aa, artificial
  peptide fold or domain or sub-domain
MRELYYEKQAQRNVIHHIRIRIYDGSEGIR

SEQ ID NO: 28385 - protein, 30 aa, artificial
  peptide fold or domain or sub-domain
MKEAASYNKMLLFSNFPNIFYQLAPFFVSQ

SEQ ID NO: 28386 - protein, 24 aa, artificial
  peptide fold or domain or sub-domain
MYKQLQEKNMQIIYSAHSNRFEWA

SEQ ID NO: 28387 - protein, 30 aa, artificial
  peptide fold or domain or sub-domain
MAVSLSKDKGVRIKGASLRKGIVQYMQQGT

SEQ ID NO: 28388 - protein, 30 aa, artificial
  peptide fold or domain or sub-domain
MLEQSFGKTNIQGVKREVAYFLERVQCIDF

SEQ ID NO: 28389 - protein, 30 aa, artificial
  peptide fold or domain or sub-domain
MKCYFGLKTSLILVQANTREKMMNALFILG

SEQ ID NO: 28390 - protein, 12 aa, artificial
  peptide fold or domain or sub-domain
MGVPVSHQYNNR

SEQ ID NO: 28391 - protein, 27 aa, artificial
  peptide fold or domain or sub-domain
MLFDVRADTMDVCLELACHVTESQWQV

SEQ ID NO: 28392 - protein, 18 aa, artificial
  peptide fold or domain or sub-domain
MVFELYEHTSLNILYVDP

SEQ ID NO: 28393 - protein, 22 aa, artificial
  peptide fold or domain or sub-domain
MRNGALLCRWQIMPVRYANHIL

SEQ ID NO: 28394 - protein, 28 aa, artificial
  peptide fold or domain or sub-domain
MRCMKTIDYGGLRHLRQHHRHVRRDGVW

SEQ ID NO: 28395 - protein, 13 aa, artificial
  peptide fold or domain or sub-domain
MCDEPVRNANNCH

SEQ ID NO: 28396 - protein, 23 aa, artificial
  peptide fold or domain or sub-domain
MNPARKKPSLLFSSLLFRSAGGK

SEQ ID NO: 28397 - protein, 19 aa, artificial
  peptide fold or domain or sub-domain
MKQSAFRPSEIESTFPISK

SEQ ID NO: 28398 - protein, 23 aa, artificial
  peptide fold or domain or sub-domain
RDITSMRGLTLSGTKTHVKGFWS

SEQ ID NO: 28399 - protein, 26 aa, artificial
  peptide fold or domain or sub-domain
MAGHAVRWQGTGSDVDLQEPEKQKPR

SEQ ID NO: 28400 - protein, 23 aa, artificial
  peptide fold or domain or sub-domain
MKTTLKKLSRYIAVVIAITLIFI

SEQ ID NO: 28401 - protein, 28 aa, artificial
  peptide fold or domain or sub-domain
MSETYPVLIVSKLLMRVIKAHARWRWRA

SEQ ID NO: 28402 - protein, 13 aa, artificial
  peptide fold or domain or sub-domain
MTRILSIIGVSLC

SEQ ID NO: 28403 - protein, 30 aa, artificial
  peptide fold or domain or sub-domain
MVPIRPIMLNGRVYTLKPPVSHHQNASARF

SEQ ID NO: 28404 - protein, 28 aa, artificial
  peptide fold or domain or sub-domain
MTRLILSSGNDSNSSNESPIYIDPLLVV

SEQ ID NO: 28405 - protein, 14 aa, artificial
  peptide fold or domain or sub-domain
MSHIQRETSCSREF

SEQ ID NO: 28406 - protein, 23 aa, artificial
  peptide fold or domain or sub-domain
MGKLRQIAFYGKGGIGKSTLEDP

SEQ ID NO: 28407 - protein, 14 aa, artificial
  peptide fold or domain or sub-domain
MTADLLSARFPQIH

SEQ ID NO: 28408 - protein, 21 aa, artificial
  peptide fold or domain or sub-domain
MLGRRQAPNCSILNRSRLQEF

SEQ ID NO: 28409 - protein, 13 aa, artificial
  peptide fold or domain or sub-domain
MRFIWSLSIFRAR

SEQ ID NO: 28410 - protein, 30 aa, artificial
  peptide fold or domain or sub-domain
MHPVGAYSLVAGAKPVTVSVRPGPVMNLIF

SEQ ID NO: 28411 - protein, 22 aa, artificial
  peptide fold or domain or sub-domain
MMGTVQVQGFPAREMRKTAFSF

SEQ ID NO: 28412 - protein, 29 aa, artificial
  peptide fold or domain or sub-domain
MSISSFPFFAGKQRCLCSVLTVHRRLING

SEQ ID NO: 28413 - protein, 28 aa, artificial
  peptide fold or domain or sub-domain
MCMCFLVGWQSNEKTQTNNRPHSQAAVD

SEQ ID NO: 28414 - protein, 19 aa, artificial
  peptide fold or domain or sub-domain
MKYAIKSHVYDGQQVVTPA

SEQ ID NO: 28415 - protein, 19 aa, artificial
  peptide fold or domain or sub-domain
MVKIIFATLPRHSININNG

SEQ ID NO: 28416 - protein, 17 aa, artificial
  peptide fold or domain or sub-domain
MAQVINTNSLSLLTQNN

SEQ ID NO: 28417 - protein, 27 aa, artificial
  peptide fold or domain or sub-domain
MERFNLRSFLLLLLAACFIASAFIPDF

SEQ ID NO: 28418 - protein, 24 aa, artificial
  peptide fold or domain or sub-domain
ELGPDPHWVCGKQGVVVAPVGGLK

SEQ ID NO: 28419 - protein, 26 aa, artificial
  peptide fold or domain or sub-domain
MKQSGGNMASTQAQKADLTFERSWQA

SEQ ID NO: 28420 - protein, 26 aa, artificial
  peptide fold or domain or sub-domain
MGEVQFISPRIGGDWSISCRSNQPSP

SEQ ID NO: 28421 - protein, 21 aa, artificial
  peptide fold or domain or sub-domain
STGSTNPWKRGPQPKRRRAAE

SEQ ID NO: 28422 - protein, 22 aa, artificial
  peptide fold or domain or sub-domain
MTIVVVLMIPINGKRLPFERLY

SEQ ID NO: 28423 - protein, 24 aa, artificial
  peptide fold or domain or sub-domain
LARPSKCNWPPCQPNRHKHAESLP

SEQ ID NO: 28424 - protein, 23 aa, artificial
  peptide fold or domain or sub-domain
MKYIIYNKFPYIGFLSKKVVYLQ

SEQ ID NO: 28425 - protein, 26 aa, artificial
  peptide fold or domain or sub-domain
MKKITGIILLLLAVIILSAWGSKPKT

SEQ ID NO: 28426 - protein, 26 aa, artificial
  peptide fold or domain or sub-domain
DKENNEVLVDPNLIINQQASVNFAFA

SEQ ID NO: 28427 - protein, 26 aa, artificial
  peptide fold or domain or sub-domain
LTQPVNSFKNLLQTTIPGMLAGSNSK

SEQ ID NO: 28428 - protein, 15 aa, artificial
  peptide fold or domain or sub-domain
MKNIVLALIATVAVG

SEQ ID NO: 28429 - protein, 14 aa, artificial
  peptide fold or domain or sub-domain
KTWTEHKLETEKSY

SEQ ID NO: 28430 - protein, 17 aa, artificial
  peptide fold or domain or sub-domain
MLTTRLKIIFSIISLSL

SEQ ID NO: 28431 - protein, 29 aa, artificial
  peptide fold or domain or sub-domain
MQTLPKPIIRSYANFTKRASLRNPFLPAP

SEQ ID NO: 28432 - protein, 17 aa, artificial
  peptide fold or domain or sub-domain
MTDQAEKSTLHFGVLWL

SEQ ID NO: 28433 - protein, 13 aa, artificial
  peptide fold or domain or sub-domain
MRALIIVDSAERL

SEQ ID NO: 28434 - protein, 29 aa, artificial
  peptide fold or domain or sub-domain
MEAIWAGQLGWKKNGGIKRFPGYLKSKKK

SEQ ID NO: 28435 - protein, 25 aa, artificial
  peptide fold or domain or sub-domain
MVNYIKIYTLQQKINIGGQNDKKRK

SEQ ID NO: 28436 - protein, 30 aa, artificial
  peptide fold or domain or sub-domain
MSDITKIKQEFDKKVAEIKGFQLSITLRAT

SEQ ID NO: 28437 - protein, 28 aa, artificial
  peptide fold or domain or sub-domain
MCLKIINKEELIMKDINRFKKNQLKVLI

SEQ ID NO: 28438 - protein, 27 aa, artificial
  peptide fold or domain or sub-domain
MWAIVFILGAVVATFVIWLLNRKFSIK

SEQ ID NO: 28439 - protein, 23 aa, artificial
  peptide fold or domain or sub-domain
MTEIVADKTVEVVKTQSKPQMEH

SEQ ID NO: 28440 - protein, 13 aa, artificial
  peptide fold or domain or sub-domain
MVSNDSHVPSLPL

SEQ ID NO: 28441 - protein, 24 aa, artificial
  peptide fold or domain or sub-domain
MEPHRTNVIIFPKVREVAEAAEQA

SEQ ID NO: 28442 - protein, 25 aa, artificial
  peptide fold or domain or sub-domain
MWFLLVLSIAVMAYLVYVMFHPEKF

SEQ ID NO: 28443 - protein, 27 aa, artificial
  peptide fold or domain or sub-domain
MEDVISIALFLAVFALLYVIHRSFDRS

SEQ ID NO: 28444 - protein, 26 aa, artificial
  peptide fold or domain or sub-domain
METRPYVQNDALRLINYRLLLHICCP

SEQ ID NO: 28445 - protein, 29 aa, artificial
  peptide fold or domain or sub-domain
MTDENTPVTTPEGDALAMRVEPVGLETEM

SEQ ID NO: 28446 - protein, 30 aa, artificial
  peptide fold or domain or sub-domain
MADENNPSTPEIEIDAEGLPLAMRVEPVGL

SEQ ID NO: 28447 - protein, 21 aa, artificial
  peptide fold or domain or sub-domain
TDTSIDIGPTRHGLTHGKPST

SEQ ID NO: 28448 - protein, 30 aa, artificial
  peptide fold or domain or sub-domain
MQIYETIFVIQSLGFASIDRVNVKIIKKIL

SEQ ID NO: 28449 - protein, 30 aa, artificial
  peptide fold or domain or sub-domain
MDFFADWSRAELILLVIMILLAIIAFNTRD

SEQ ID NO: 28450 - protein, 30 aa, artificial
  peptide fold or domain or sub-domain
MFLQCNDTDTAGKEGHIAYIKYKSLEEDLI

SEQ ID NO: 28451 - protein, 30 aa, artificial
  peptide fold or domain or sub-domain
MLLTVGHFFHANLTHSFLKSINNKNYLKKL

SEQ ID NO: 28452 - protein, 30 aa, artificial
  peptide fold or domain or sub-domain
MLWETVVDKVEICQNRIVTFTLKNGSEVVA

SEQ ID NO: 28453 - protein, 21 aa, artificial
  peptide fold or domain or sub-domain
CADDYGDFAGFGLYEGCTTVG

SEQ ID NO: 28454 - protein, 25 aa, artificial
  peptide fold or domain or sub-domain
PAPTTMATSPRVWAYDRRSGHRRRC

SEQ ID NO: 28455 - protein, 26 aa, artificial
  peptide fold or domain or sub-domain
MGNGSMGNAQWVMAQWVMAQWVMLNG

SEQ ID NO: 28456 - protein, 28 aa, artificial
  peptide fold or domain or sub-domain
IIIGKAFLENKFTITEAVRCWQKELFPV

SEQ ID NO: 28457 - protein, 29 aa, artificial
  peptide fold or domain or sub-domain
MLKIIINGPANKAGEPSLKFPCLSKRTAF

SEQ ID NO: 28458 - protein, 25 aa, artificial
  peptide fold or domain or sub-domain
MARMHDDLALVTSSCSCDFFAELTP

SEQ ID NO: 28459 - protein, 27 aa, artificial
  peptide fold or domain or sub-domain
MKVLVTGGTGFIGSHTAISLIKAGYDV

SEQ ID NO: 28460 - protein, 16 aa, artificial
  peptide fold or domain or sub-domain
MKPLDYICEGQSDNAD

SEQ ID NO: 28461 - protein, 20 aa, artificial
  peptide fold or domain or sub-domain
MTADLLSARFLKFTEKSDIS

SEQ ID NO: 28462 - protein, 23 aa, artificial
  peptide fold or domain or sub-domain
MTGLHCLSEVRSEGTDQRSVYLT

SEQ ID NO: 28463 - protein, 27 aa, artificial
  peptide fold or domain or sub-domain
MKRVDYICEVPSNCDDATEDRSIYLTF

SEQ ID NO: 28464 - protein, 18 aa, artificial
  peptide fold or domain or sub-domain
MKNLNIIDRVDAGADDQC

SEQ ID NO: 28465 - protein, 24 aa, artificial
  peptide fold or domain or sub-domain
MNQPDYSCNVSGNSADCSVYLTFD

SEQ ID NO: 28466 - protein, 22 aa, artificial
  peptide fold or domain or sub-domain
MTRVNCFSEVRGVCTDGAGQHN

SEQ ID NO: 28467 - protein, 15 aa, artificial
  peptide fold or domain or sub-domain
MKRLDYTCKVSGNSI

SEQ ID NO: 28468 - protein, 24 aa, artificial
  peptide fold or domain or sub-domain
VPDFINEGDELVINTLEGTYKGRA

SEQ ID NO: 28469 - protein, 29 aa, artificial
  peptide fold or domain or sub-domain
MLDVENEQKISVQLTKFSLKNICLRQRQS

SEQ ID NO: 28470 - protein, 12 aa, artificial
  peptide fold or domain or sub-domain
MLDVENEQRISV

SEQ ID NO: 28471 - protein, 15 aa, artificial
  peptide fold or domain or sub-domain
LNLTTVIDNLRKRHQ

SEQ ID NO: 28472 - protein, 12 aa, artificial
  peptide fold or domain or sub-domain
MTASQPAESGQL

SEQ ID NO: 28473 - protein, 23 aa, artificial
  peptide fold or domain or sub-domain
MSHNQFQFIGNLTRDTEVRHGNS

SEQ ID NO: 28474 - protein, 26 aa, artificial
  peptide fold or domain or sub-domain
MELVLNINNKNVTVNVPTDEMLLTTL

SEQ ID NO: 28475 - protein, 13 aa, artificial
  peptide fold or domain or sub-domain
AQLKITQTKAVIN

SEQ ID NO: 28476 - protein, 26 aa, artificial
  peptide fold or domain or sub-domain
MKVPVMMADENAKLNNPEDDRKKFFV

SEQ ID NO: 28477 - protein, 25 aa, artificial
  peptide fold or domain or sub-domain
SAGIPGLNPYYFGNYGRSIGFGVRQ

SEQ ID NO: 28478 - protein, 14 aa, artificial
  peptide fold or domain or sub-domain
PVFGHADLPAPDDT

SEQ ID NO: 28479 - protein, 22 aa, artificial
  peptide fold or domain or sub-domain
AYSNTYQEFNTNIDQAKAGNAQ

SEQ ID NO: 28480 - protein, 13 aa, artificial
  peptide fold or domain or sub-domain
TRKNTTENPWAKF

SEQ ID NO: 28481 - protein, 21 aa, artificial
  peptide fold or domain or sub-domain
MKFNLNGQAVEFNGEPDTPLL

SEQ ID NO: 28482 - protein, 14 aa, artificial
  peptide fold or domain or sub-domain
MKIDNIITYANNGG

SEQ ID NO: 28483 - protein, 22 aa, artificial
  peptide fold or domain or sub-domain
ATDIFTAPLGYISEYGVRSSML

SEQ ID NO: 28484 - protein, 14 aa, artificial
  peptide fold or domain or sub-domain
AKKYVYFFADEKAE

SEQ ID NO: 28485 - protein, 20 aa, artificial
  peptide fold or domain or sub-domain
VEKNITVCASVDPTICIKQA

SEQ ID NO: 28486 - protein, 22 aa, artificial
  peptide fold or domain or sub-domain
SDNRIIALTMPKKGLTMEEGLI

SEQ ID NO: 28487 - protein, 16 aa, artificial
  peptide fold or domain or sub-domain
ADGQDGAPLNQVNTYD

SEQ ID NO: 28488 - protein, 22 aa, artificial
  peptide fold or domain or sub-domain
ADLKVTQIKSTIGAKANQKDSL

SEQ ID NO: 28489 - protein, 16 aa, artificial
  peptide fold or domain or sub-domain
MENLNFWPLQDIKVNP

SEQ ID NO: 28490 - protein, 25 aa, artificial
  peptide fold or domain or sub-domain
LTGSRRPSVVYLHNAETGERVLRAF

SEQ ID NO: 28491 - protein, 22 aa, artificial
  peptide fold or domain or sub-domain
MVKVGINGFGRIGRLAFNRLQN

SEQ ID NO: 28492 - protein, 13 aa, artificial
  peptide fold or domain or sub-domain
AFNIRNHLLSLAN

SEQ ID NO: 28493 - protein, 26 aa, artificial
  peptide fold or domain or sub-domain
VRYSRESPEDKLKKIIDDLDAKENEL

SEQ ID NO: 28494 - protein, 18 aa, artificial
  peptide fold or domain or sub-domain
MYLKKAESLSSSHEKVKV

SEQ ID NO: 28495 - protein, 17 aa, artificial
  peptide fold or domain or sub-domain
DLKIGVAGPVTGANAAF

SEQ ID NO: 28496 - protein, 20 aa, artificial
  peptide fold or domain or sub-domain
MKKINHWINGKNVAGSDYFQ

SEQ ID NO: 28497 - protein, 29 aa, artificial
  peptide fold or domain or sub-domain
GQAYQGGLHRAFSLFERTKGLLNIIKATS

SEQ ID NO: 28498 - protein, 30 aa, artificial
  peptide fold or domain or sub-domain
MAELMHHLLTGETPAALTVAPAGSSGLRQP

SEQ ID NO: 28499 - protein, 30 aa, artificial
  peptide fold or domain or sub-domain
MKTILRFVAGYDIASHKKKTGGYPWERGKA

SEQ ID NO: 28500 - protein, 29 aa, artificial
  peptide fold or domain or sub-domain
MKTVLPKAVLPKAVFRKAVLPKTVLLKAE

SEQ ID NO: 28501 - protein, 29 aa, artificial
  peptide fold or domain or sub-domain
MVDQASIFPDLANPSFQDHANEAIHRFTI

SEQ ID NO: 28502 - protein, 25 aa, artificial
  peptide fold or domain or sub-domain
IRRWCKRHETFAADSIPNVQLNQSV

SEQ ID NO: 28503 - protein, 17 aa, artificial
  peptide fold or domain or sub-domain
MRSASLVVCRAKCCMTI

SEQ ID NO: 28504 - protein, 20 aa, artificial
  peptide fold or domain or sub-domain
MKCKKMNRVQLKHASVSMAL

SEQ ID NO: 28505 - protein, 29 aa, artificial
  peptide fold or domain or sub-domain
MMHADVRNRRHDHLTDAEVRKLIAESQQG

SEQ ID NO: 28506 - protein, 28 aa, artificial
  peptide fold or domain or sub-domain
MIISISPTTKSKVVGLTPPPYPHQYIKV

SEQ ID NO: 28507 - protein, 30 aa, artificial
  peptide fold or domain or sub-domain
MTKPAILALADGSIFRAAKPLEPTVKPLER

SEQ ID NO: 28508 - protein, 25 aa, artificial
  peptide fold or domain or sub-domain
MYPVIRVSVTGIFYAFLAFEWRKIT

SEQ ID NO: 28509 - protein, 30 aa, artificial
  peptide fold or domain or sub-domain
MIEFVKEVGMALLWLFVGYLVGERSQQKNK

SEQ ID NO: 28510 - protein, 28 aa, artificial
  peptide fold or domain or sub-domain
MFWIIGNVLTVSTMNSMDCLMMISIKRK

SEQ ID NO: 28511 - protein, 27 aa, artificial
  peptide fold or domain or sub-domain
MSEGVTAPRGTPVAYATTTPTARFPFI

SEQ ID NO: 28512 - protein, 24 aa, artificial
  peptide fold or domain or sub-domain
MVMQKRDPKQARLVMEATGIYHED

SEQ ID NO: 28513 - protein, 30 aa, artificial
  peptide fold or domain or sub-domain
MSFTEWVILGVVLGCVIGALLKIFGKKKDR

SEQ ID NO: 28514 - protein, 30 aa, artificial
  peptide fold or domain or sub-domain
MPLHRLHCLLDSYGECALIRRAVTLNYNTS

SEQ ID NO: 28515 - protein, 28 aa, artificial
  peptide fold or domain or sub-domain
MFNPVAMPPTLLRPGDNVRFLPLKEGVC

SEQ ID NO: 28516 - protein, 29 aa, artificial
  peptide fold or domain or sub-domain
MQEITPFETIFIDKVEENVPENNNGYNRF

SEQ ID NO: 28517 - protein, 25 aa, artificial
  peptide fold or domain or sub-domain
MTDHEFINYQKNNKLISNEEYGGIE

SEQ ID NO: 28518 - protein, 24 aa, artificial
  peptide fold or domain or sub-domain
MDWIQDNSEMYLAGDWLTQTGLTG

SEQ ID NO: 28519 - protein, 27 aa, artificial
  peptide fold or domain or sub-domain
MPDLLLIYQRTDSEIKLYRVGSHSDLF

SEQ ID NO: 28520 - protein, 23 aa, artificial
  peptide fold or domain or sub-domain
MNNSTYRTYNIESIKDEFFNIGL

SEQ ID NO: 28521 - protein, 30 aa, artificial
  peptide fold or domain or sub-domain
MGQKLIQMVSVMELQNLITQLDMQIKINLQ

SEQ ID NO: 28522 - protein, 28 aa, artificial
  peptide fold or domain or sub-domain
MPISRQNQNGYSILVNSINDTMFSVYSP

SEQ ID NO: 28523 - protein, 26 aa, artificial
  peptide fold or domain or sub-domain
MKRWVVNILGRKGDKSVRIGAYTRNI

SEQ ID NO: 28524 - protein, 21 aa, artificial
  peptide fold or domain or sub-domain
MKNNKSFNKILELTETALATP

SEQ ID NO: 28525 - protein, 14 aa, artificial
  peptide fold or domain or sub-domain
ANNIVKFERQAVFA

SEQ ID NO: 28526 - protein, 26 aa, artificial
  peptide fold or domain or sub-domain
KKDSFGQNNNQSGGSFSHQLDDDVPF

SEQ ID NO: 28527 - protein, 23 aa, artificial
  peptide fold or domain or sub-domain
APATPSETTLKQWLKIIRKKVKQ

SEQ ID NO: 28528 - protein, 30 aa, artificial
  peptide fold or domain or sub-domain
MDTLATAVALVGRPAQLIPNSVRPFRVFGG

SEQ ID NO: 28529 - protein, 30 aa, artificial
  peptide fold or domain or sub-domain
MLIRNQELIADERVSRGPETTAWATPFSGG

SEQ ID NO: 28530 - protein, 30 aa, artificial
  peptide fold or domain or sub-domain
MKRPLSRGTAKACQLRIHSDMTFYKIRVDF

SEQ ID NO: 28531 - protein, 30 aa, artificial
  peptide fold or domain or sub-domain
MPHANPSAFPRLSNPNFQPIHLKQFMEELT

SEQ ID NO: 28532 - protein, 30 aa, artificial
  peptide fold or domain or sub-domain
MMIVRLGPTAVFRFAPIAAVLQARFKVQPK

SEQ ID NO: 28533 - protein, 30 aa, artificial
  peptide fold or domain or sub-domain
MIPLAGDPVSSHRTVEFGVLGTYLVSGGSL

SEQ ID NO: 28534 - protein, 30 aa, artificial
  peptide fold or domain or sub-domain
MRFGSLALVAYDSAIKHSWPRPSSVRRLRM

SEQ ID NO: 28535 - protein, 26 aa, artificial
  peptide fold or domain or sub-domain
MVSLQTMQIKWCICLNRKLEVSLTFQ

SEQ ID NO: 28536 - protein, 30 aa, artificial
  peptide fold or domain or sub-domain
MLIIFVHIIAPVISGCAVAYYTYWLSKRNK

SEQ ID NO: 28537 - protein, 26 aa, artificial
  peptide fold or domain or sub-domain
MPAPVVLILAAGRGKRFLTSGGNTIN

SEQ ID NO: 28538 - protein, 26 aa, artificial
  peptide fold or domain or sub-domain
ITALADPEGRYMTGAVVPVDGGLSLT

SEQ ID NO: 28539 - protein, 29 aa, artificial
  peptide fold or domain or sub-domain
MKYTLIRKLLIYSKDLYDEYSGNTCIRFW

SEQ ID NO: 28540 - protein, 24 aa, artificial
  peptide fold or domain or sub-domain
MEAEGHWVNRISKLDLLWFAGLTV

SEQ ID NO: 28541 - protein, 28 aa, artificial
  peptide fold or domain or sub-domain
FPLTDTGKIKRHELKKCFEKKFELRQSI

SEQ ID NO: 28542 - protein, 14 aa, artificial
  peptide fold or domain or sub-domain
EIFIRKNKRICVDE

SEQ ID NO: 28543 - protein, 21 aa, artificial
  peptide fold or domain or sub-domain
LDINFKKIDSYFKARYNNKRN

SEQ ID NO: 28544 - protein, 26 aa, artificial
  peptide fold or domain or sub-domain
QHVFHLYQFVEIVVKSRFISVIRDNQ

SEQ ID NO: 28545 - protein, 27 aa, artificial
  peptide fold or domain or sub-domain
MLNTLTTKAYIKAQLKQSVLSEKIKQV

SEQ ID NO: 28546 - protein, 28 aa, artificial
  peptide fold or domain or sub-domain
YDYLLGPDSNNKVGQIMIGQSWVGYGPR

SEQ ID NO: 28547 - protein, 29 aa, artificial
  peptide fold or domain or sub-domain
MTFEYAAGAVLSVLLGAYLIYALLRPARF

SEQ ID NO: 28548 - protein, 23 aa, artificial
  peptide fold or domain or sub-domain
MPGTRGCHTGVRVLDEALPHRVD

SEQ ID NO: 28549 - protein, 22 aa, artificial
  peptide fold or domain or sub-domain
MTWSMRNAPQLVILARSKSIKG

SEQ ID NO: 28550 - protein, 22 aa, artificial
  peptide fold or domain or sub-domain
MRFAYCTVQPVFSISNVTSGCG

SEQ ID NO: 28551 - protein, 27 aa, artificial
  peptide fold or domain or sub-domain
MFRFHAAAHQPLRRFSPSRRLETAPVL

SEQ ID NO: 28552 - protein, 23 aa, artificial
  peptide fold or domain or sub-domain
VSYFMSLNLKQAVKILHKELFEQ

SEQ ID NO: 28553 - protein, 17 aa, artificial
  peptide fold or domain or sub-domain
MDLSPLDVRYQEFPRAF

SEQ ID NO: 28554 - protein, 19 aa, artificial
  peptide fold or domain or sub-domain
MGNCSLFVINTVHYQPNEK

SEQ ID NO: 28555 - protein, 28 aa, artificial
  peptide fold or domain or sub-domain
MDFLTSLSEGGQFAIQIIIVLICLFYGA

SEQ ID NO: 28556 - protein, 25 aa, artificial
  peptide fold or domain or sub-domain
MQTAFLCTLFVQTPSLSDCKIVAVQ

SEQ ID NO: 28557 - protein, 30 aa, artificial
  peptide fold or domain or sub-domain
MCWSNRYRKYYWSWNMSVLIALIIMNLRNH

SEQ ID NO: 28558 - protein, 24 aa, artificial
  peptide fold or domain or sub-domain
YETLDGSKHLVADASLIYRPTNAT

SEQ ID NO: 28559 - protein, 21 aa, artificial
  peptide fold or domain or sub-domain
MTDNRGFTLVELISVVLILSV

SEQ ID NO: 28560 - protein, 28 aa, artificial
  peptide fold or domain or sub-domain
MFNKQLINATVCCCGSRLMRPTVWRAYF

SEQ ID NO: 28561 - protein, 30 aa, artificial
  peptide fold or domain or sub-domain
MITSNSNLIQLRQKKNLGGFPRFFSDQNAS

SEQ ID NO: 28562 - protein, 30 aa, artificial
  peptide fold or domain or sub-domain
MRKRPWNKIIDMSSLVALTYVFEHDDITDS

SEQ ID NO: 28563 - protein, 30 aa, artificial
  peptide fold or domain or sub-domain
MLEKLGQARVTAGSCLAKFQTETLLKSSFK

SEQ ID NO: 28564 - protein, 29 aa, artificial
  peptide fold or domain or sub-domain
GIQAASALRRGSMFDVMEQQRCYAAGQSP

SEQ ID NO: 28565 - protein, 30 aa, artificial
  peptide fold or domain or sub-domain
MEFKNKQRMYREFFMTLKESFKFSSKKRYI

SEQ ID NO: 28566 - protein, 23 aa, artificial
  peptide fold or domain or sub-domain
GSMQHCRDLSPQGLVSDRNAVSK

SEQ ID NO: 28567 - protein, 28 aa, artificial
  peptide fold or domain or sub-domain
WQWRPWFPGTPGYEATSSLDPVTDVQQS

SEQ ID NO: 28568 - protein, 23 aa, artificial
  peptide fold or domain or sub-domain
LAEGPGHSGKAALIDLVAVKPAR

SEQ ID NO: 28569 - protein, 14 aa, artificial
  peptide fold or domain or sub-domain
KFDANDSILKDQTQ

SEQ ID NO: 28570 - protein, 14 aa, artificial
  peptide fold or domain or sub-domain
MLGVQKKRSTKTAA

SEQ ID NO: 28571 - protein, 20 aa, artificial
  peptide fold or domain or sub-domain
FLFGSSNYTKTQYPIVLTRG

SEQ ID NO: 28572 - protein, 19 aa, artificial
  peptide fold or domain or sub-domain
ATNLRGVMAALLLPFDQCQ

SEQ ID NO: 28573 - protein, 18 aa, artificial
  peptide fold or domain or sub-domain
TQPLNYFQNTASQRYGTY

SEQ ID NO: 28574 - protein, 20 aa, artificial
  peptide fold or domain or sub-domain
AQGIRGREVFAINDIAAKNM

SEQ ID NO: 28575 - protein, 15 aa, artificial
  peptide fold or domain or sub-domain
AKTSSAGVVIRDIFL

SEQ ID NO: 28576 - protein, 15 aa, artificial
  peptide fold or domain or sub-domain
KVTMTQGPSKVQAAT

SEQ ID NO: 28577 - protein, 20 aa, artificial
  peptide fold or domain or sub-domain
EGGGENDNVGDSTSSLDYAL

SEQ ID NO: 28578 - protein, 17 aa, artificial
  peptide fold or domain or sub-domain
ALDKRLGELRLNADAGG

SEQ ID NO: 28579 - protein, 20 aa, artificial
  peptide fold or domain or sub-domain
MDKILRIDVGAEGGPKLTTL

SEQ ID NO: 28580 - protein, 16 aa, artificial
  peptide fold or domain or sub-domain
ELARYETTNYTESGSF

SEQ ID NO: 28581 - protein, 17 aa, artificial
  peptide fold or domain or sub-domain
SGDSKKVIYNAGSMVTL

SEQ ID NO: 28582 - protein, 30 aa, artificial
  peptide fold or domain or sub-domain
TTQLVDPITLQVISGALKTIAEEMGHVLYR

SEQ ID NO: 28583 - protein, 22 aa, artificial
  peptide fold or domain or sub-domain
ARIGVDVGGTNTDLILETTERD

SEQ ID NO: 28584 - protein, 25 aa, artificial
  peptide fold or domain or sub-domain
AVDAAPLEVYDSNKVYNGGDQVQHE

SEQ ID NO: 28585 - protein, 28 aa, artificial
  peptide fold or domain or sub-domain
MNGSTTKTHDIIEKTEKFGARNYHPLPI

SEQ ID NO: 28586 - protein, 17 aa, artificial
  peptide fold or domain or sub-domain
MDQFVGLHMIYTYQNGV

SEQ ID NO: 28587 - protein, 27 aa, artificial
  peptide fold or domain or sub-domain
ADAKKTPQQQFDALWAAGIVTGYPDGF

SEQ ID NO: 28588 - protein, 28 aa, artificial
  peptide fold or domain or sub-domain
ISCGGGCNASWDIPFVSLMLDEGVDVTK

SEQ ID NO: 28589 - protein, 15 aa, artificial
  peptide fold or domain or sub-domain
VAFDSETFQSGMKDR

SEQ ID NO: 28590 - protein, 20 aa, artificial
  peptide fold or domain or sub-domain
MLFKYITKPLYEQVAKDMAP

SEQ ID NO: 28591 - protein, 20 aa, artificial
  peptide fold or domain or sub-domain
MQNIFILMTPYNLASEVIMP

SEQ ID NO: 28592 - protein, 22 aa, artificial
  peptide fold or domain or sub-domain
ADNYAATRYPIILVHGLTGTDR

SEQ ID NO: 28593 - protein, 21 aa, artificial
  peptide fold or domain or sub-domain
SKIYDVIILGAGPAGLAAGLY

SEQ ID NO: 28594 - protein, 21 aa, artificial
  peptide fold or domain or sub-domain
LRVNRVGSSDDIWTWANRYNL

SEQ ID NO: 28595 - protein, 28 aa, artificial
  peptide fold or domain or sub-domain
KICRVCGTSYHLVFNPPLEEGKCDKDGG

SEQ ID NO: 28596 - protein, 16 aa, artificial
  peptide fold or domain or sub-domain
PQFTEIFRQVDLPAGT

SEQ ID NO: 28597 - protein, 15 aa, artificial
  peptide fold or domain or sub-domain
AVYTMKQLKDSGTHF

SEQ ID NO: 28598 - protein, 15 aa, artificial
  peptide fold or domain or sub-domain
ALTAEQIIEILASYG

SEQ ID NO: 28599 - protein, 15 aa, artificial
  peptide fold or domain or sub-domain
PAKNVPANSRRKAKH

SEQ ID NO: 28600 - protein, 16 aa, artificial
  peptide fold or domain or sub-domain
QTVPWGDNRVQAPHAQ

SEQ ID NO: 28601 - protein, 17 aa, artificial
  peptide fold or domain or sub-domain
SKTVKVVLNETINKLGF

SEQ ID NO: 28602 - protein, 20 aa, artificial
  peptide fold or domain or sub-domain
SEYSVREELKPSGLDGISDA

SEQ ID NO: 28603 - protein, 16 aa, artificial
  peptide fold or domain or sub-domain
VLSEGEWELVLHVWAK

SEQ ID NO: 28604 - protein, 18 aa, artificial
  peptide fold or domain or sub-domain
MNTCSLSLTPLLRHSVGF

SEQ ID NO: 28605 - protein, 27 aa, artificial
  peptide fold or domain or sub-domain
DEPNQPSTPEAVTKTVTIDASKPETGQ

SEQ ID NO: 28606 - protein, 22 aa, artificial
  peptide fold or domain or sub-domain
HQAGDILVRGGLAFVSPQTSSD

SEQ ID NO: 28607 - protein, 20 aa, artificial
  peptide fold or domain or sub-domain
ADYSGDIHKNDYKRRMQFNV

SEQ ID NO: 28608 - protein, 14 aa, artificial
  peptide fold or domain or sub-domain
APTTPQGQGIVTFN

SEQ ID NO: 28609 - protein, 15 aa, artificial
  peptide fold or domain or sub-domain
MERAWWKEAVVYQIY

SEQ ID NO: 28610 - protein, 17 aa, artificial
  peptide fold or domain or sub-domain
DEYKQVDVGKVGMVATA

SEQ ID NO: 28611 - protein, 13 aa, artificial
  peptide fold or domain or sub-domain
MSTYQNILNDKIV

SEQ ID NO: 28612 - protein, 15 aa, artificial
  peptide fold or domain or sub-domain
GTQKAHTIPSAYKVI

SEQ ID NO: 28613 - protein, 20 aa, artificial
  peptide fold or domain or sub-domain
GTMGPVWTPGNVTVPHEGTA

SEQ ID NO: 28614 - protein, 25 aa, artificial
  peptide fold or domain or sub-domain
NMAQEMSLGEALPDGLVIGSAVAGG

SEQ ID NO: 28615 - protein, 20 aa, artificial
  peptide fold or domain or sub-domain
STPLIAGTGPSAVCQLISNA

SEQ ID NO: 28616 - protein, 14 aa, artificial
  peptide fold or domain or sub-domain
MLGVQKKFSTYTAA

SEQ ID NO: 28617 - protein, 18 aa, artificial
  peptide fold or domain or sub-domain
VNFGLAFKSEPIGDAPNA

SEQ ID NO: 28618 - protein, 23 aa, artificial
  peptide fold or domain or sub-domain
VNFLGAVKDEPIKKGTRFYRKVA

SEQ ID NO: 28619 - protein, 29 aa, artificial
  peptide fold or domain or sub-domain
MDLSRKPAQPIPGLKNVLVEKTAGSINIY

SEQ ID NO: 28620 - protein, 26 aa, artificial
  peptide fold or domain or sub-domain
LRNLANPCDPAWSSYFAQRRAAIDVD

SEQ ID NO: 28621 - protein, 26 aa, artificial
  peptide fold or domain or sub-domain
MVLVNGTEQSCISISDRSAQYGDGCL

SEQ ID NO: 28622 - protein, 11 aa, artificial
  peptide fold or domain or sub-domain
MKKNTLSAILM

SEQ ID NO: 28623 - protein, 16 aa, artificial
  peptide fold or domain or sub-domain
LIAYIPQVEYYAFNFS

SEQ ID NO: 28624 - protein, 28 aa, artificial
  peptide fold or domain or sub-domain
MVQRCHRLLQAIFHLGTTFHRLRRVSVC

SEQ ID NO: 28625 - protein, 27 aa, artificial
  peptide fold or domain or sub-domain
QDDPVKTYLMPNNLPFVIVGAPQGDTN

SEQ ID NO: 28626 - protein, 26 aa, artificial
  peptide fold or domain or sub-domain
MGQRTNYCFTAPTIRYEKVRSQSPYF

SEQ ID NO: 28627 - protein, 28 aa, artificial
  peptide fold or domain or sub-domain
MNDILKHFPVMKKELIQSLKIKKNGIYI

SEQ ID NO: 28628 - protein, 15 aa, artificial
  peptide fold or domain or sub-domain
MSCELKLKDRIGVIN

SEQ ID NO: 28629 - protein, 23 aa, artificial
  peptide fold or domain or sub-domain
MGNTHSHSEPGAACLCRSGRAGR

SEQ ID NO: 28630 - protein, 21 aa, artificial
  peptide fold or domain or sub-domain
MHILKKLDFSDPKLRAKLAKG

SEQ ID NO: 28631 - protein, 13 aa, artificial
  peptide fold or domain or sub-domain
FLMSRKQGISGPL

SEQ ID NO: 28632 - protein, 30 aa, artificial
  peptide fold or domain or sub-domain
MYIKGYRQENRLSVVNPHFPDGVPLWGRSL

SEQ ID NO: 28633 - protein, 24 aa, artificial
  peptide fold or domain or sub-domain
MNFNDMSIFVTIYETRSINKSSKI

SEQ ID NO: 28634 - protein, 17 aa, artificial
  peptide fold or domain or sub-domain
MKRKQSLISWVFIMSIV

SEQ ID NO: 28635 - protein, 16 aa, artificial
  peptide fold or domain or sub-domain
IRLLSKDGGKSGSFRA

SEQ ID NO: 28636 - protein, 24 aa, artificial
  peptide fold or domain or sub-domain
YPNIDVVIELMGGIDDAKSHILQA

SEQ ID NO: 28637 - protein, 26 aa, artificial
  peptide fold or domain or sub-domain
MKITLLYGGRSAEQSMKCPFFPHFQF

SEQ ID NO: 28638 - protein, 24 aa, artificial
  peptide fold or domain or sub-domain
MYFWLTSAPAHFESGESIKGDRSP

SEQ ID NO: 28639 - protein, 30 aa, artificial
  peptide fold or domain or sub-domain
RKPCPGWAARSRSWRAIPCSSVKTRPSARR

SEQ ID NO: 28640 - protein, 22 aa, artificial
  peptide fold or domain or sub-domain
MKQKTIAKEFSVTGVGLHSGVD

SEQ ID NO: 28641 - protein, 28 aa, artificial
  peptide fold or domain or sub-domain
AFLTKPWLSEWVQTHSLLNSTLMSLGMR

SEQ ID NO: 28642 - protein, 17 aa, artificial
  peptide fold or domain or sub-domain
AAAAIYGHFVDIRNLVK

SEQ ID NO: 28643 - protein, 24 aa, artificial
  peptide fold or domain or sub-domain
MARDFSRAQRVSQEMQKEIAIILQ

SEQ ID NO: 28644 - protein, 27 aa, artificial
  peptide fold or domain or sub-domain
MSKIERISAFLNDKEVDMTFITNPTTL

SEQ ID NO: 28645 - protein, 26 aa, artificial
  peptide fold or domain or sub-domain
KIRLNQIKFGYNFNNFHPEFERVVEI

SEQ ID NO: 28646 - protein, 17 aa, artificial
  peptide fold or domain or sub-domain
CGRIYTKVLTKERNGEL

SEQ ID NO: 28647 - protein, 17 aa, artificial
  peptide fold or domain or sub-domain
NFLGQPFCTDRKNSFRI

SEQ ID NO: 28648 - protein, 24 aa, artificial
  peptide fold or domain or sub-domain
LSENPCIKFAIIQQKEEGLSSFCV

SEQ ID NO: 28649 - protein, 18 aa, artificial
  peptide fold or domain or sub-domain
RIIPDQKDHFYKALKFSE

SEQ ID NO: 28650 - protein, 22 aa, artificial
  peptide fold or domain or sub-domain
FFYYRKSFLKRTLKAFLLKDKI

SEQ ID NO: 28651 - protein, 21 aa, artificial
  peptide fold or domain or sub-domain
FLPGVSNILQLISFPKHIAKI

SEQ ID NO: 28652 - protein, 27 aa, artificial
  peptide fold or domain or sub-domain
NSFMLLLPEEEIVKIFKENCTLQNFVL

SEQ ID NO: 28653 - protein, 23 aa, artificial
  peptide fold or domain or sub-domain
IRGSVANRTRTAPYPPIPNRNQI

SEQ ID NO: 28654 - protein, 30 aa, artificial
  peptide fold or domain or sub-domain
MKGVGNDEMTHRRSIHRGAATVRFQNRFLI

SEQ ID NO: 28655 - protein, 29 aa, artificial
  peptide fold or domain or sub-domain
MLWLPSILLCHFGIIQRICPGSRNSMYIL

SEQ ID NO: 28656 - protein, 28 aa, artificial
  peptide fold or domain or sub-domain
QINTSFFIAAKLRFLHLWWESIKEQTIS

SEQ ID NO: 28657 - protein, 27 aa, artificial
  peptide fold or domain or sub-domain
MRISVDLILLPGSVIGADSQYAIINID

SEQ ID NO: 28658 - protein, 30 aa, artificial
  peptide fold or domain or sub-domain
MQDFIIAKKLYFCFKYISSILNINEYYFKV

SEQ ID NO: 28659 - protein, 29 aa, artificial
  peptide fold or domain or sub-domain
MKPYQRFNPVQCINTLHNRSAISDSLWQV

SEQ ID NO: 28660 - protein, 26 aa, artificial
  peptide fold or domain or sub-domain
LKEYNERCTSIAGIWYFRPGSGKSSD

SEQ ID NO: 28661 - protein, 30 aa, artificial
  peptide fold or domain or sub-domain
MLETLKKYAENQGIEDNYPKKIYNQKEKKP

SEQ ID NO: 28662 - protein, 17 aa, artificial
  peptide fold or domain or sub-domain
PSDKSICHWDFLCLFGF

SEQ ID NO: 28663 - protein, 26 aa, artificial
  peptide fold or domain or sub-domain
MTTGNYAAVMLISYAGLRARETTALR

SEQ ID NO: 28664 - protein, 28 aa, artificial
  peptide fold or domain or sub-domain
MNISRHLSPSGAGGVSGIAPELYFREGD

SEQ ID NO: 28665 - protein, 18 aa, artificial
  peptide fold or domain or sub-domain
MRRKYQLLQCKLSAACCD

SEQ ID NO: 28666 - protein, 14 aa, artificial
  peptide fold or domain or sub-domain
AVLDPDGYFLRFSE

SEQ ID NO: 28667 - protein, 30 aa, artificial
  peptide fold or domain or sub-domain
MLDKNQSCITKDEYLFSYQEDYGITEADHM

SEQ ID NO: 28668 - protein, 30 aa, artificial
  peptide fold or domain or sub-domain
MQKTLSRYLEEVFFVHIFISKNIYTNHDKI

SEQ ID NO: 28669 - protein, 30 aa, artificial
  peptide fold or domain or sub-domain
MEILTFFKLFLSVVVGIAFILWYDEENLIL

SEQ ID NO: 28670 - protein, 29 aa, artificial
  peptide fold or domain or sub-domain
MKKRKIYDDKLQIDYFSDSYLKFEEDFYR

SEQ ID NO: 28671 - protein, 27 aa, artificial
  peptide fold or domain or sub-domain
MCLIYNNIIESGVRDSIHNIWAQKIDN

SEQ ID NO: 28672 - protein, 29 aa, artificial
  peptide fold or domain or sub-domain
MYSLYIYINLIKFSTIFAELEEAFFKNFL

SEQ ID NO: 28673 - protein, 30 aa, artificial
  peptide fold or domain or sub-domain
MPAPVKLQGWRRREGSRSREAVVTPLVVEA

SEQ ID NO: 28674 - protein, 30 aa, artificial
  peptide fold or domain or sub-domain
MRWFPILDAGVAEVVAGGGRAGIISLMTDA

SEQ ID NO: 28675 - protein, 26 aa, artificial
  peptide fold or domain or sub-domain
RLDLADFAAPLSGVREVAFFPPMTGG

SEQ ID NO: 28676 - protein, 30 aa, artificial
  peptide fold or domain or sub-domain
MNNNFKNSDGGGRTKSTTFTKTSDFNPNTE

SEQ ID NO: 28677 - protein, 30 aa, artificial
  peptide fold or domain or sub-domain
MLWSLDEEIQAAVRTPPSTGRMPDDKHDAS

SEQ ID NO: 28678 - protein, 26 aa, artificial
  peptide fold or domain or sub-domain
MEGRSYLVVGDKINKMLNGKQKSHVV

SEQ ID NO: 28679 - protein, 25 aa, artificial
  peptide fold or domain or sub-domain
MLKNNFPNKKGNQFTYEFGLLFYCT

SEQ ID NO: 28680 - protein, 23 aa, artificial
  peptide fold or domain or sub-domain
MTRQTNNTFETLDLEVLANVEVV

SEQ ID NO: 28681 - protein, 29 aa, artificial
  peptide fold or domain or sub-domain
MKEHFVIRGKRDFIVNKVADEYIGYDLLD

SEQ ID NO: 28682 - protein, 25 aa, artificial
  peptide fold or domain or sub-domain
MIYEEDKFMRFIVFLKPLYQLQLGL

SEQ ID NO: 28683 - protein, 24 aa, artificial
  peptide fold or domain or sub-domain
MEVAEIRQKISENQEKLVSFGRSL

SEQ ID NO: 28684 - protein, 27 aa, artificial
  peptide fold or domain or sub-domain
MLDNVEYMEYTVFVKFFKELIDYTNFK

SEQ ID NO: 28685 - protein, 27 aa, artificial
  peptide fold or domain or sub-domain
MLENVQTYLSKQGVKYIKPEKAEPHQV

SEQ ID NO: 28686 - protein, 22 aa, artificial
  peptide fold or domain or sub-domain
MKKVKFLPTLKIAFEILIVVCG

SEQ ID NO: 28687 - protein, 30 aa, artificial
  peptide fold or domain or sub-domain
MASIATHGRMAKMAASLNLGVCAANGSILD

SEQ ID NO: 28688 - protein, 25 aa, artificial
  peptide fold or domain or sub-domain
MLHAFYTFYLNFLFSSGAFSKPLFN

SEQ ID NO: 28689 - protein, 30 aa, artificial
  peptide fold or domain or sub-domain
MSCLPEGGELTVSTQRSINNPRLDMHLDGQ

SEQ ID NO: 28690 - protein, 30 aa, artificial
  peptide fold or domain or sub-domain
MPAVKHLTQRAPEIRGATSRCLATHPRHRT

SEQ ID NO: 28691 - protein, 30 aa, artificial
  peptide fold or domain or sub-domain
MDTASAARTAMVCFMGWFSLGESYWLQQMA

SEQ ID NO: 28692 - protein, 30 aa, artificial
  peptide fold or domain or sub-domain
MAKMQPIFKPGEDGMLPSSLIERGLCRPAP

SEQ ID NO: 28693 - protein, 13 aa, artificial
  peptide fold or domain or sub-domain
MTSLAAKKPEGRP

SEQ ID NO: 28694 - protein, 27 aa, artificial
  peptide fold or domain or sub-domain
MMARKIAFMLFSLLVIFSSSAVAKGAD

SEQ ID NO: 28695 - protein, 30 aa, artificial
  peptide fold or domain or sub-domain
MDSRLSETEKYLWKFITKNINKIPNLSIVS

SEQ ID NO: 28696 - protein, 23 aa, artificial
  peptide fold or domain or sub-domain
MVSEILEVELTSKDIRGQVQLDI

SEQ ID NO: 28697 - protein, 30 aa, artificial
  peptide fold or domain or sub-domain
MSKELEKVLESSSMAKGDGWKVMAKGDGWE

SEQ ID NO: 28698 - protein, 17 aa, artificial
  peptide fold or domain or sub-domain
MEQIAIFFKKDIRNNEN

SEQ ID NO: 28699 - protein, 22 aa, artificial
  peptide fold or domain or sub-domain
MEALKTLGQAAHKGNTVSYQKL

SEQ ID NO: 28700 - protein, 28 aa, artificial
  peptide fold or domain or sub-domain
MQIELISASELADESFNIVINDLKPIET

SEQ ID NO: 28701 - protein, 30 aa, artificial
  peptide fold or domain or sub-domain
MGPALEDFGARLTPPQSLLRHTLLNFIENR

SEQ ID NO: 28702 - protein, 29 aa, artificial
  peptide fold or domain or sub-domain
MSKAFDEKYIAILVVNQLKKMLKVVFLAE

SEQ ID NO: 28703 - protein, 26 aa, artificial
  peptide fold or domain or sub-domain
MGKEDYEIYRMNQRLYGHALAQEDMT

SEQ ID NO: 28704 - protein, 29 aa, artificial
  peptide fold or domain or sub-domain
MYCNEDKKRSNNENYKYIILFVFNYAKWL

SEQ ID NO: 28705 - protein, 30 aa, artificial
  peptide fold or domain or sub-domain
MMNEIFENQKDFLNKLFKRYQDQKDNKKVL

SEQ ID NO: 28706 - protein, 29 aa, artificial
  peptide fold or domain or sub-domain
MEWFYFLTIVLFLKKRTIVNFLKKEFYIK

SEQ ID NO: 28707 - protein, 29 aa, artificial
  peptide fold or domain or sub-domain
MNYNLRTKKKNVPRGTFLNKKTNSLFNKF

SEQ ID NO: 28708 - protein, 30 aa, artificial
  peptide fold or domain or sub-domain
MQAKVEREVERDLVYTLRRLCDPSGSERTK

SEQ ID NO: 28709 - protein, 27 aa, artificial
  peptide fold or domain or sub-domain
HADGTRQMVERSFGPHGGHLGEVEVRV

SEQ ID NO: 28710 - protein, 29 aa, artificial
  peptide fold or domain or sub-domain
GEEVRLAGWCNTYRDHGGVVFIDLRDKSG

SEQ ID NO: 28711 - protein, 29 aa, artificial
  peptide fold or domain or sub-domain
MTVWALFDSGNGSYFKGANSLNSSGGGEY

SEQ ID NO: 28712 - protein, 30 aa, artificial
  peptide fold or domain or sub-domain
MIGSFLIDSPLSNSPGAEVGQKDMATSDHP

SEQ ID NO: 28713 - protein, 27 aa, artificial
  peptide fold or domain or sub-domain
MVEGLNKLKTHSENMQNVFLVADYNNI

SEQ ID NO: 28714 - protein, 29 aa, artificial
  peptide fold or domain or sub-domain
MTTQNLNKLPGTIAVPMDKIRITIYCPSF

SEQ ID NO: 28715 - protein, 28 aa, artificial
  peptide fold or domain or sub-domain
MFIPNEIGNYTFDSKGYRELKTEKTQHK

SEQ ID NO: 28716 - protein, 30 aa, artificial
  peptide fold or domain or sub-domain
MNIKLFKMVIINNLNLSFKIENYKFFGIKL

SEQ ID NO: 28717 - protein, 27 aa, artificial
  peptide fold or domain or sub-domain
MKNYKQYATSLVSFQNTRDVDKARRFK

SEQ ID NO: 28718 - protein, 30 aa, artificial
  peptide fold or domain or sub-domain
MGASRGDLPRGKKGLFKREGAHRIKSRVFE

SEQ ID NO: 28719 - protein, 30 aa, artificial
  peptide fold or domain or sub-domain
MGDSFTLALFMFQPSPGGSPAGLPGDGDEA

SEQ ID NO: 28720 - protein, 30 aa, artificial
  peptide fold or domain or sub-domain
MTGMSVEDYQAMMNAGGCSPDGFRSIRDKN

SEQ ID NO: 28721 - protein, 29 aa, artificial
  peptide fold or domain or sub-domain
MKTHVSNVLAKLEVEDRTQAALYAVKQEI

SEQ ID NO: 28722 - protein, 22 aa, artificial
  peptide fold or domain or sub-domain
DNENHTTVSDSKLVPNMSLDQS

SEQ ID NO: 28723 - protein, 30 aa, artificial
  peptide fold or domain or sub-domain
MPEENFRQMLADYYRLRGWDGEGRPPEGSL

SEQ ID NO: 28724 - protein, 12 aa, artificial
  peptide fold or domain or sub-domain
MLFCYCHALIDF

SEQ ID NO: 28725 - protein, 26 aa, artificial
  peptide fold or domain or sub-domain
MKSVVTTAVGAADAAGRFPSTSDLES

SEQ ID NO: 28726 - protein, 30 aa, artificial
  peptide fold or domain or sub-domain
MIAFALAWPGKPCNILKNCWHCLLADYVID

SEQ ID NO: 28727 - protein, 30 aa, artificial
  peptide fold or domain or sub-domain
MSRRQTFSELLHASPLPAAELVITQSRPIW

SEQ ID NO: 28728 - protein, 30 aa, artificial
  peptide fold or domain or sub-domain
MEALRDRYARDEISDEEFEQKKKVLQDKKK

SEQ ID NO: 28729 - protein, 30 aa, artificial
  peptide fold or domain or sub-domain
MVKWIYSEEGKLGLAITNLYAIRFGWFLQE

SEQ ID NO: 28730 - protein, 30 aa, artificial
  peptide fold or domain or sub-domain
MLFLLRFKNKILGKFQPDYDDRSLYKKYGL

SEQ ID NO: 28731 - protein, 30 aa, artificial
  peptide fold or domain or sub-domain
MHNFELVNRQRAALMTRIQAAGQWQVTHAG

SEQ ID NO: 28732 - protein, 30 aa, artificial
  peptide fold or domain or sub-domain
MAGKITPSPCPLRHINLPKQMEKGAIGALF

SEQ ID NO: 28733 - protein, 30 aa, artificial
  peptide fold or domain or sub-domain
MSEPMLRGHEGTEMTLVAINQTITNTESES

SEQ ID NO: 28734 - protein, 30 aa, artificial
  peptide fold or domain or sub-domain
MFFNYKLISFSMHFAQRSPLLRLLINIPLN

SEQ ID NO: 28735 - protein, 30 aa, artificial
  peptide fold or domain or sub-domain
MPSEENISKNKLMIKIIDIISVLLRFGFMP

SEQ ID NO: 28736 - protein, 30 aa, artificial
  peptide fold or domain or sub-domain
MPEGIISLYENNDQFSINNQQKDKKEISSV

SEQ ID NO: 28737 - protein, 26 aa, artificial
  peptide fold or domain or sub-domain
MTNKKVTDRHSVSNFFAYLLKRKKFY

SEQ ID NO: 28738 - protein, 28 aa, artificial
  peptide fold or domain or sub-domain
MKKNLNELQKFIVMNLQHSLKIFIREQP

SEQ ID NO: 28739 - protein, 28 aa, artificial
  peptide fold or domain or sub-domain
MPISKMFPIFFQYLILENIFYPLYKDFE

SEQ ID NO: 28740 - protein, 30 aa, artificial
  peptide fold or domain or sub-domain
MAALDLTHLTDNIKKQRIGLFIVKGCMQWD

SEQ ID NO: 28741 - protein, 30 aa, artificial
  peptide fold or domain or sub-domain
MLPAIVVPSPIFVVTLRANPLDEMIERFDA

SEQ ID NO: 28742 - protein, 30 aa, artificial
  peptide fold or domain or sub-domain
MASTSKKPMKISMVILAFIVSGAIVFYFKK

SEQ ID NO: 28743 - protein, 23 aa, artificial
  peptide fold or domain or sub-domain
MSNFLKKSDEGKIFIFADASVSK

SEQ ID NO: 28744 - protein, 30 aa, artificial
  peptide fold or domain or sub-domain
MLRDFFFQIIAPLLVGVMVTLVDHWLDGGQ

SEQ ID NO: 28745 - protein, 28 aa, artificial
  peptide fold or domain or sub-domain
MRLPFWSLVMRQTDDRADNDKALIASET

SEQ ID NO: 28746 - protein, 28 aa, artificial
  peptide fold or domain or sub-domain
MAIFIDTVKAREIFDSRGAFSNIVFQTE

SEQ ID NO: 28747 - protein, 22 aa, artificial
  peptide fold or domain or sub-domain
MNDGHIICYLVAAVLAALKSVI

SEQ ID NO: 28748 - protein, 21 aa, artificial
  peptide fold or domain or sub-domain
MNNKLTQSEQSFYFWFFRHDL

SEQ ID NO: 28749 - protein, 24 aa, artificial
  peptide fold or domain or sub-domain
MKKLGWGRNEWVAHFYVVNTKSDV

SEQ ID NO: 28750 - protein, 27 aa, artificial
  peptide fold or domain or sub-domain
MLAGDNFKDKKTTACMILTVAASDDSI

SEQ ID NO: 28751 - protein, 22 aa, artificial
  peptide fold or domain or sub-domain
MIAVMLLISGAAMWMWANWKTK

SEQ ID NO: 28752 - protein, 28 aa, artificial
  peptide fold or domain or sub-domain
MSKKPKPRRGFGFLFELCYAEQAFSVMI

SEQ ID NO: 28753 - protein, 20 aa, artificial
  peptide fold or domain or sub-domain
MPKDGNDAVAVFWQNEMKIN

SEQ ID NO: 28754 - protein, 23 aa, artificial
  peptide fold or domain or sub-domain
MAAQAKTHRLSRGIYHLTGDAFF

SEQ ID NO: 28755 - protein, 22 aa, artificial
  peptide fold or domain or sub-domain
MKIVNYMSAGLIALDCNNKVTT

SEQ ID NO: 28756 - protein, 30 aa, artificial
  peptide fold or domain or sub-domain
MIGYLLIAGGFGVIVGHCLGHSGNWRKWIE

SEQ ID NO: 28757 - protein, 28 aa, artificial
  peptide fold or domain or sub-domain
MKIFMDWLANVFAPKAKKFTQMPAIAAL

SEQ ID NO: 28758 - protein, 25 aa, artificial
  peptide fold or domain or sub-domain
MNKVNWLMINLHIEGMKQEQGQNDV

SEQ ID NO: 28759 - protein, 30 aa, artificial
  peptide fold or domain or sub-domain
MSVADWETLMLLVVVWLPMIWVGRPPKRHG

SEQ ID NO: 28760 - protein, 30 aa, artificial
  peptide fold or domain or sub-domain
MGSIVTLVTWSAMIVLIGAEIIRGIFMFRG

SEQ ID NO: 28761 - protein, 25 aa, artificial
  peptide fold or domain or sub-domain
MKWMKLAFLAGLSLSLWGTATPIYV

SEQ ID NO: 28762 - protein, 23 aa, artificial
  peptide fold or domain or sub-domain
MIKTKMKKKAEQAQLLLNALILE

SEQ ID NO: 28763 - protein, 27 aa, artificial
  peptide fold or domain or sub-domain
MRVVEVILNDNGNGFLSIQEQFTQRLG

SEQ ID NO: 28764 - protein, 27 aa, artificial
  peptide fold or domain or sub-domain
MFIPNNNLSIIGLLIKQVVEILVYVVN

SEQ ID NO: 28765 - protein, 17 aa, artificial
  peptide fold or domain or sub-domain
MTTLTTSEMGPLADWVV

SEQ ID NO: 28766 - protein, 30 aa, artificial
  peptide fold or domain or sub-domain
MLSGKDQRKIKLVRLQKAKSINDLAFIILQ

SEQ ID NO: 28767 - protein, 30 aa, artificial
  peptide fold or domain or sub-domain
MIDNDYVAIISAFLFSNHFLYLLKFLQKQS

SEQ ID NO: 28768 - protein, 30 aa, artificial
  peptide fold or domain or sub-domain
MLYVIYLIRHPDPNLAMWKAPLAHVNKPLL

SEQ ID NO: 28769 - protein, 21 aa, artificial
  peptide fold or domain or sub-domain
MDCGEEGGKVYDYYKTFVEIS

SEQ ID NO: 28770 - protein, 28 aa, artificial
  peptide fold or domain or sub-domain
MDYYGLTLPEVIGLNVHPENFQESECSF

SEQ ID NO: 28771 - protein, 28 aa, artificial
  peptide fold or domain or sub-domain
MAGTMHLGQVHEGLPFQPVCADKDETDP

SEQ ID NO: 28772 - protein, 21 aa, artificial
  peptide fold or domain or sub-domain
MQANRFLFVKKKMTKKNATFF

SEQ ID NO: 28773 - protein, 25 aa, artificial
  peptide fold or domain or sub-domain
MENDENQAVREEVARQRQMQNDMPK

SEQ ID NO: 28774 - protein, 29 aa, artificial
  peptide fold or domain or sub-domain
MQCFVGCYSMINYVGDKPYIMIGQNKYVA

SEQ ID NO: 28775 - protein, 29 aa, artificial
  peptide fold or domain or sub-domain
MAREYLKIRLQLTTNKFTKKYLRLLLEAW

SEQ ID NO: 28776 - protein, 25 aa, artificial
  peptide fold or domain or sub-domain
MLKKMHWDFFTGQSYKSEADIAAIS

SEQ ID NO: 28777 - protein, 26 aa, artificial
  peptide fold or domain or sub-domain
MVKKCEAKQAFACFFHAESFEISYKK

SEQ ID NO: 28778 - protein, 25 aa, artificial
  peptide fold or domain or sub-domain
MIMDVLKESRKAPRLLPIRFGMLSS

SEQ ID NO: 28779 - protein, 18 aa, artificial
  peptide fold or domain or sub-domain
MWAGKTSGKTDQIADDFN

SEQ ID NO: 28780 - protein, 29 aa, artificial
  peptide fold or domain or sub-domain
MKPKKPLAGPDKRHLGELSTIKHKGQVAK

SEQ ID NO: 28781 - protein, 30 aa, artificial
  peptide fold or domain or sub-domain
MFKVNQKGRRAREAKDEGAFLKEKILAKLA

SEQ ID NO: 28782 - protein, 23 aa, artificial
  peptide fold or domain or sub-domain
MNKFINISMNNFSYMISLKALLL

SEQ ID NO: 28783 - protein, 29 aa, artificial
  peptide fold or domain or sub-domain
MGIGFLLALFGFFGITYKKKNNHEKIGFH

SEQ ID NO: 28784 - protein, 29 aa, artificial
  peptide fold or domain or sub-domain
MSEYNSDLVKKTFFWIKKIRIKRNYTMPT

SEQ ID NO: 28785 - protein, 25 aa, artificial
  peptide fold or domain or sub-domain
MEVLNNIDKSVQKDIFEILKENVNR

SEQ ID NO: 28786 - protein, 29 aa, artificial
  peptide fold or domain or sub-domain
MSAINLQTSVGFMKQPLFFDLQLSKILKK

SEQ ID NO: 28787 - protein, 22 aa, artificial
  peptide fold or domain or sub-domain
MVNKKMSRGQIDFVNAFEEKNV

SEQ ID NO: 28788 - protein, 26 aa, artificial
  peptide fold or domain or sub-domain
MQVNHLGKTLLNYRQQNKLTIRELAV

SEQ ID NO: 28789 - protein, 30 aa, artificial
  peptide fold or domain or sub-domain
MRTISAVLAIKKPPVVTPGVKTFELKPPEG

SEQ ID NO: 28790 - protein, 25 aa, artificial
  peptide fold or domain or sub-domain
MQLMQELRDEEGRDLPAQRFTFDWD

SEQ ID NO: 28791 - protein, 17 aa, artificial
  peptide fold or domain or sub-domain
MDQKTSSKAPFKGIHEK

SEQ ID NO: 28792 - protein, 22 aa, artificial
  peptide fold or domain or sub-domain
MDKRVVIYIGPDEVSNLTTRND

SEQ ID NO: 28793 - protein, 30 aa, artificial
  peptide fold or domain or sub-domain
MLREAVKMLPAQGLLVARPRQGTSVAPESQ

SEQ ID NO: 28794 - protein, 28 aa, artificial
  peptide fold or domain or sub-domain
MVVNSINCGMNVAEATNAPRFHHQWLPD

SEQ ID NO: 28795 - protein, 20 aa, artificial
  peptide fold or domain or sub-domain
VALICELDEQWSFVGNKAHQ

SEQ ID NO: 28796 - protein, 29 aa, artificial
  peptide fold or domain or sub-domain
GTDGMDAAFNFGLDSLIAGFERLRSSTTD

SEQ ID NO: 28797 - protein, 30 aa, artificial
  peptide fold or domain or sub-domain
MPYLAKFAFTVSMIMFVVGGGMALYAMFYG

SEQ ID NO: 28798 - protein, 25 aa, artificial
  peptide fold or domain or sub-domain
MLRKLQYPFLCHLLLPCNISAGRCD

SEQ ID NO: 28799 - protein, 25 aa, artificial
  peptide fold or domain or sub-domain
MADTEALDRHVNLGHFAFKIDLIVN

SEQ ID NO: 28800 - protein, 25 aa, artificial
  peptide fold or domain or sub-domain
MSRVLFEPLTFLQTGSGLPDEKTLG

SEQ ID NO: 28801 - protein, 29 aa, artificial
  peptide fold or domain or sub-domain
MHKRLFRARQEKLVQNQGLSNRMLDLLPL

SEQ ID NO: 28802 - protein, 27 aa, artificial
  peptide fold or domain or sub-domain
MNVTKGEIARELMEFIGKQIKIDIAIV

SEQ ID NO: 28803 - protein, 25 aa, artificial
  peptide fold or domain or sub-domain
MSFCLLFFPASHDRKPKNKNKSVLY

SEQ ID NO: 28804 - protein, 23 aa, artificial
  peptide fold or domain or sub-domain
MMRLGHEGKRAGHKAGPRMSEDI

SEQ ID NO: 28805 - protein, 30 aa, artificial
  peptide fold or domain or sub-domain
MFVELCDCAVYRVLNDLPINVDLTAPPRTK

SEQ ID NO: 28806 - protein, 28 aa, artificial
  peptide fold or domain or sub-domain
MSPKQTFSAAAFNRIKRFAETVVCEIPL

SEQ ID NO: 28807 - protein, 30 aa, artificial
  peptide fold or domain or sub-domain
MAPHFLVHAAPFLISIVEKTKAGSTGHKTM

SEQ ID NO: 28808 - protein, 24 aa, artificial
  peptide fold or domain or sub-domain
MAILNAMWLELRSEDERRRLEGRE

SEQ ID NO: 28809 - protein, 28 aa, artificial
  peptide fold or domain or sub-domain
MTFLVADSDFTAASKMKHLLHSAKNSLL

SEQ ID NO: 28810 - protein, 28 aa, artificial
  peptide fold or domain or sub-domain
MASGMDAMVEPWHDEVDGKLMPEPLKQD

SEQ ID NO: 28811 - protein, 25 aa, artificial
  peptide fold or domain or sub-domain
MLDLVLAGTFETGGLPLVRGLWDGA

SEQ ID NO: 28812 - protein, 30 aa, artificial
  peptide fold or domain or sub-domain
MTGQKIGGAPGSVTEADSAHVLEVDIFERR

SEQ ID NO: 28813 - protein, 24 aa, artificial
  peptide fold or domain or sub-domain
MNGIIYLVGLVVVVGAILSFIGLI

SEQ ID NO: 28814 - protein, 28 aa, artificial
  peptide fold or domain or sub-domain
MTEAFSKCGTEIAIERLYSLLELVFIGF

SEQ ID NO: 28815 - protein, 25 aa, artificial
  peptide fold or domain or sub-domain
MEAMEGAKCRLSICSARSLYFIQAM

SEQ ID NO: 28816 - protein, 29 aa, artificial
  peptide fold or domain or sub-domain
MMITQRLERDAAGLLKPYPRMLIGRTECA

SEQ ID NO: 28817 - protein, 26 aa, artificial
  peptide fold or domain or sub-domain
MRFEAFVELDKRFEGCKKTSRLAGAE

SEQ ID NO: 28818 - protein, 25 aa, artificial
  peptide fold or domain or sub-domain
MGILRPVERTADPGRASGMYFKGTD

SEQ ID NO: 28819 - protein, 25 aa, artificial
  peptide fold or domain or sub-domain
MLFNTSIVIPARTKTARDDGKWVLA

SEQ ID NO: 28820 - protein, 23 aa, artificial
  peptide fold or domain or sub-domain
MGRGWQNRMLLAISFIVDAVTMV

SEQ ID NO: 28821 - protein, 28 aa, artificial
  peptide fold or domain or sub-domain
MMLAVSILRFMLFVLPNEVEGVVDLKCW

SEQ ID NO: 28822 - protein, 26 aa, artificial
  peptide fold or domain or sub-domain
MGTYVPAVIFATGSGFGRPFASPLIC

SEQ ID NO: 28823 - protein, 30 aa, artificial
  peptide fold or domain or sub-domain
MPPKSEKLLSFFAKSDVIGMEITKNEQMLI

SEQ ID NO: 28824 - protein, 29 aa, artificial
  peptide fold or domain or sub-domain
MMSHGMTKEIALPRVPRIEMNGFQTSQRS

SEQ ID NO: 28825 - protein, 27 aa, artificial
  peptide fold or domain or sub-domain
MLGVRLVAHLVAIAAEKKTPAHEERAL

SEQ ID NO: 28826 - protein, 25 aa, artificial
  peptide fold or domain or sub-domain
MNSFHFRYISDYMPKNLTCGRIFKF

SEQ ID NO: 28827 - protein, 20 aa, artificial
  peptide fold or domain or sub-domain
MTIRKNLRIAGEEMDDPGQT

SEQ ID NO: 28828 - protein, 30 aa, artificial
  peptide fold or domain or sub-domain
MPAGALEEKNKDTPQMKWAAFHLRRSGTSR

SEQ ID NO: 28829 - protein, 27 aa, artificial
  peptide fold or domain or sub-domain
MEVVGSYIAVAQAYEETTTSNAAINIT

SEQ ID NO: 28830 - protein, 26 aa, artificial
  peptide fold or domain or sub-domain
MREIQDQVSRDGADESYLVGWFVVEA

SEQ ID NO: 28831 - protein, 30 aa, artificial
  peptide fold or domain or sub-domain
MLTTLAYSASLPAIALGLIYYVSACSGLVY

SEQ ID NO: 28832 - protein, 30 aa, artificial
  peptide fold or domain or sub-domain
MHLLLRGNIMVWVDESVMHHWGMAHTCKRV

SEQ ID NO: 28833 - protein, 25 aa, artificial
  peptide fold or domain or sub-domain
DGQLFVIYDQKSLALEKGAIIVEEE

SEQ ID NO: 28834 - protein, 30 aa, artificial
  peptide fold or domain or sub-domain
MKNKINDIIKSRRFNLGFLYLKIRNTEEKR

SEQ ID NO: 28835 - protein, 30 aa, artificial
  peptide fold or domain or sub-domain
MVVGFTQAVDKHNLSTAFLHLLQKGFLVFM

SEQ ID NO: 28836 - protein, 30 aa, artificial
  peptide fold or domain or sub-domain
MKCVFNNIENICKVFERICVEFVKNNKIQR

SEQ ID NO: 28837 - protein, 30 aa, artificial
  peptide fold or domain or sub-domain
MLQFIFSIPFYKNGEDIIVDMMAGQKDLVF

SEQ ID NO: 28838 - protein, 30 aa, artificial
  peptide fold or domain or sub-domain
MFRACFLCSVDGRGDRAADLSLPLVKESAQ

SEQ ID NO: 28839 - protein, 27 aa, artificial
  peptide fold or domain or sub-domain
MPASSLGTGSPAADRLDATHERRREVI

SEQ ID NO: 28840 - protein, 27 aa, artificial
  peptide fold or domain or sub-domain
MRFCYWLVLFFWGFKKALFLSRSNKSY

SEQ ID NO: 28841 - protein, 30 aa, artificial
  peptide fold or domain or sub-domain
MKFYSKNEVLQKRVFKQQLLLTFYKRTHKG

SEQ ID NO: 28842 - protein, 28 aa, artificial
  peptide fold or domain or sub-domain
MEHSLIITETASTIASQTLMGISYHKRA

SEQ ID NO: 28843 - protein, 28 aa, artificial
  peptide fold or domain or sub-domain
MLFKNPLIHRPPYKKFRLTNDKLFCIQS

SEQ ID NO: 28844 - protein, 30 aa, artificial
  peptide fold or domain or sub-domain
MRKNHSKYSWETLYLKISFLGFCLELKIKR

SEQ ID NO: 28845 - protein, 25 aa, artificial
  peptide fold or domain or sub-domain
MLIPFYFRFLDYSLKKGLVKVINRL

SEQ ID NO: 28846 - protein, 25 aa, artificial
  peptide fold or domain or sub-domain
MENVMSWFNIDFEIKSDNNIDKTLL

SEQ ID NO: 28847 - protein, 21 aa, artificial
  peptide fold or domain or sub-domain
MCTCEEGSGKCSYCDGALDIF

SEQ ID NO: 28848 - protein, 30 aa, artificial
  peptide fold or domain or sub-domain
MVLGIWKKAENYVDKFDELIIVKNKELFVI

SEQ ID NO: 28849 - protein, 30 aa, artificial
  peptide fold or domain or sub-domain
MCLQTAIKNYFLLKDLMHKIFKIKNCQTHN

SEQ ID NO: 28850 - protein, 30 aa, artificial
  peptide fold or domain or sub-domain
MEKKNLTIETKILHFNKIKKPLKIGASLFY

SEQ ID NO: 28851 - protein, 30 aa, artificial
  peptide fold or domain or sub-domain
MGLGEGIIPINFIKFYAFSVLALFILILKT

SEQ ID NO: 28852 - protein, 30 aa, artificial
  peptide fold or domain or sub-domain
MLMRINSFYNKFSIMQNLFSLKGLKIILLS

SEQ ID NO: 28853 - protein, 30 aa, artificial
  peptide fold or domain or sub-domain
MFKSTPNNAINADRKKLRYAPHFASGYGWR

SEQ ID NO: 28854 - protein, 29 aa, artificial
  peptide fold or domain or sub-domain
MGYRSSRTSPYYCRVGQCVVKKSAVSHYH

SEQ ID NO: 28855 - protein, 30 aa, artificial
  peptide fold or domain or sub-domain
MPVEIPNINPGITQQGLALKRDGWPLTLLT

SEQ ID NO: 28856 - protein, 30 aa, artificial
  peptide fold or domain or sub-domain
MSVCKLSFLEIVVYSGIVGWGVLLRENCLV

SEQ ID NO: 28857 - protein, 30 aa, artificial
  peptide fold or domain or sub-domain
MDSSYLIHAAVGVTDFRECSGGHKYIASQS

SEQ ID NO: 28858 - protein, 30 aa, artificial
  peptide fold or domain or sub-domain
MQNEAYIVQGFRVGFFLQAMVSNDADVILY

SEQ ID NO: 28859 - protein, 30 aa, artificial
  peptide fold or domain or sub-domain
MAPTRAGFRKFGGVLSVEVIRPHFVSLLLN

SEQ ID NO: 28860 - protein, 30 aa, artificial
  peptide fold or domain or sub-domain
MALGQFFHARKDTSKISVLNAAIFDVKELS

SEQ ID NO: 28861 - protein, 30 aa, artificial
  peptide fold or domain or sub-domain
MSAALRALMNDVQVVMIAQKYSTSRNFLAI

SEQ ID NO: 28862 - protein, 30 aa, artificial
  peptide fold or domain or sub-domain
MRNKLQDILGKQQSANPLSKECEAVTEIFV

SEQ ID NO: 28863 - protein, 30 aa, artificial
  peptide fold or domain or sub-domain
MGLCMESITAKVKSQKYRTGFLLLKEVFSV

SEQ ID NO: 28864 - protein, 30 aa, artificial
  peptide fold or domain or sub-domain
MEKHGDITRKTVNENACVNPPLIKSNATYF

SEQ ID NO: 28865 - protein, 29 aa, artificial
  peptide fold or domain or sub-domain
MFLYVSITDNLYFVRGKEIIRLHSPENLG

SEQ ID NO: 28866 - protein, 30 aa, artificial
  peptide fold or domain or sub-domain
MHLLCNKWNCVQLLDLAWFVIVNYHSLPCY

SEQ ID NO: 28867 - protein, 30 aa, artificial
  peptide fold or domain or sub-domain
MFYRFINIPIHEFNLYLCYSYDYSADMAEY

SEQ ID NO: 28868 - protein, 30 aa, artificial
  peptide fold or domain or sub-domain
MVPNVINYIVNSLVHKDVFGHIVLDNIIAC

SEQ ID NO: 28869 - protein, 30 aa, artificial
  peptide fold or domain or sub-domain
MWFWYFNVNNSYVLLYIRYGTVLKMSNAFS

SEQ ID NO: 28870 - protein, 30 aa, artificial
  peptide fold or domain or sub-domain
MLLQIDYKLILPKIVYVIEKKHHKKFTEYF

SEQ ID NO: 28871 - protein, 30 aa, artificial
  peptide fold or domain or sub-domain
MEFNDKIITVTVQENYNNPSIISHNKNCKT

SEQ ID NO: 28872 - protein, 30 aa, artificial
  peptide fold or domain or sub-domain
MFCFSYVIVLNCDRNFVYDLFVKLDACFSS

SEQ ID NO: 28873 - protein, 30 aa, artificial
  peptide fold or domain or sub-domain
MSDTIIGYQNNMYCASINHVDSDTQCIIIH

SEQ ID NO: 28874 - protein, 30 aa, artificial
  peptide fold or domain or sub-domain
MFAITMHMHILTFLAKLLYVLLITDKQNIY

SEQ ID NO: 28875 - protein, 30 aa, artificial
  peptide fold or domain or sub-domain
MGIFCFVGTLGNELTTKYMINVVILQCNSM

SEQ ID NO: 28876 - protein, 30 aa, artificial
  peptide fold or domain or sub-domain
MLLIKQAVQPTLPFTYHNVPLKVYIKQVFR

SEQ ID NO: 28877 - protein, 30 aa, artificial
  peptide fold or domain or sub-domain
MWFSEFCALEKENVNFTEKHFFNIFNLELV

SEQ ID NO: 28878 - protein, 30 aa, artificial
  peptide fold or domain or sub-domain
MAGIEDSLIATDAIFVQIVLNPEVAVHKTG

SEQ ID NO: 28879 - protein, 30 aa, artificial
  peptide fold or domain or sub-domain
MSCAVGMFEVSRDFGEAIALCKAIDLQLIV

SEQ ID NO: 28880 - protein, 30 aa, artificial
  peptide fold or domain or sub-domain
MFLLVGELAVWVGTLRAVDSVLVIGFLKFL

SEQ ID NO: 28881 - protein, 30 aa, artificial
  peptide fold or domain or sub-domain
MVIHLYVVMLATSGDMSSGYEAPQVLELYS

SEQ ID NO: 28882 - protein, 30 aa, artificial
  peptide fold or domain or sub-domain
MGRAALQSGEDAQIHDVKWKSHKVCMLFNL

SEQ ID NO: 28883 - protein, 30 aa, artificial
  peptide fold or domain or sub-domain
MEDLQIKRQEYCPPKYHDTILLIVYESVVW

SEQ ID NO: 28884 - protein, 30 aa, artificial
  peptide fold or domain or sub-domain
MEIILCLEGVFSCWKKGSQYILLQGRCSCY

SEQ ID NO: 28885 - protein, 30 aa, artificial
  peptide fold or domain or sub-domain
MLYPTICDAKYSEDTEVKHHHSKQAFLRKL

SEQ ID NO: 28886 - protein, 30 aa, artificial
  peptide fold or domain or sub-domain
MFSSEKVVLFFDCYYINKGCSVMSGATGFM

SEQ ID NO: 28887 - protein, 30 aa, artificial
  peptide fold or domain or sub-domain
MRDSWITHVHQESLLMQHKLVVYAVYRSDA

SEQ ID NO: 28888 - protein, 30 aa, artificial
  peptide fold or domain or sub-domain
MHPVRIWGILSMLHGELLDIVLYLGILRDT

SEQ ID NO: 28889 - protein, 30 aa, artificial
  peptide fold or domain or sub-domain
MDRGHIVDAAGDDSGCNVAGVRGLIKVIFS

SEQ ID NO: 28890 - protein, 30 aa, artificial
  peptide fold or domain or sub-domain
MIGELVHISAAIEQKYTALSMRNAAKAPKQ

SEQ ID NO: 28891 - protein, 30 aa, artificial
  peptide fold or domain or sub-domain
MLGVLAVVGVSLSIVGFEYALVCRMLVLCG

SEQ ID NO: 28892 - protein, 30 aa, artificial
  peptide fold or domain or sub-domain
MPVVSKTTLLNYATHQQLYLYNIATDVVRW

SEQ ID NO: 28893 - protein, 30 aa, artificial
  peptide fold or domain or sub-domain
MTLQILWVDLLRSLKEGSFWFWPGIPPEGY

SEQ ID NO: 28894 - protein, 30 aa, artificial
  peptide fold or domain or sub-domain
MKSGEISALCLQGSLKEVGFAERLAASILY

SEQ ID NO: 28895 - protein, 30 aa, artificial
  peptide fold or domain or sub-domain
MQRPRITAHQEIKGHSSNTSLGEGLGLMVC

SEQ ID NO: 28896 - protein, 30 aa, artificial
  peptide fold or domain or sub-domain
MIKGIPYILTYSHLLDFARMDMGSHTVDGS

SEQ ID NO: 28897 - protein, 30 aa, artificial
  peptide fold or domain or sub-domain
MACTWDLNSQNPALIIQESHPSEGGQTDLR

SEQ ID NO: 28898 - protein, 30 aa, artificial
  peptide fold or domain or sub-domain
MAAFIPNLQGSRGKLQCRALAWAVFVFGLH

SEQ ID NO: 28899 - protein, 30 aa, artificial
  peptide fold or domain or sub-domain
MQNIQNALVKAFPSTESWELLLQTGEEVNA

SEQ ID NO: 28900 - protein, 27 aa, artificial
  peptide fold or domain or sub-domain
MLVGRDPLPLASRPDWSDYLWPASGRE

SEQ ID NO: 28901 - protein, 30 aa, artificial
  peptide fold or domain or sub-domain
MGLALEGQSVSIQEHASNPKTLNFAEFTEL

SEQ ID NO: 28902 - protein, 29 aa, artificial
  peptide fold or domain or sub-domain
MVLSGSLKRCAPPAALTPSPSPSPSAPRR

SEQ ID NO: 28903 - protein, 30 aa, artificial
  peptide fold or domain or sub-domain
MSAPTEQAAAQVELSWSFPGFRRRGSLRAS

SEQ ID NO: 28904 - protein, 27 aa, artificial
  peptide fold or domain or sub-domain
MPNDGMLSDKPTVDARRVRGEVADLLD

SEQ ID NO: 28905 - protein, 30 aa, artificial
  peptide fold or domain or sub-domain
VQVGSPRQAIVVSWLARIHLPALSKESAYR

SEQ ID NO: 28906 - protein, 30 aa, artificial
  peptide fold or domain or sub-domain
MFQLTINRYKKKSFYWYKEVIESNGETLDN

SEQ ID NO: 28907 - protein, 30 aa, artificial
  peptide fold or domain or sub-domain
MENPIDRTIRLMAIAAGVVSLLVYAVFQFV

SEQ ID NO: 28908 - protein, 30 aa, artificial
  peptide fold or domain or sub-domain
MVARACRSSSFPFTFMFVRQRLPSGVKSRS

SEQ ID NO: 28909 - protein, 30 aa, artificial
  peptide fold or domain or sub-domain
MLRFGAGLRGVRSHRILLRIDLSPAAGYRN

SEQ ID NO: 28910 - protein, 30 aa, artificial
  peptide fold or domain or sub-domain
MIFARALAAENKKMGDNARYSLAVMVSSFL

SEQ ID NO: 28911 - protein, 30 aa, artificial
  peptide fold or domain or sub-domain
MFVFHKIMRIFPHYPNEQVVIIEYSSAAIE

SEQ ID NO: 28912 - protein, 30 aa, artificial
  peptide fold or domain or sub-domain
MECYACDLTDCHSLYVIGHTLAVDGGLSLT

SEQ ID NO: 28913 - protein, 30 aa, artificial
  peptide fold or domain or sub-domain
MLWTLKELSPVRAYGYRRHSTHHAQAPGLA

SEQ ID NO: 28914 - protein, 30 aa, artificial
  peptide fold or domain or sub-domain
MSGFNNITFILLTFLQVLGKENGEIQTEFP

SEQ ID NO: 28915 - protein, 30 aa, artificial
  peptide fold or domain or sub-domain
MQRLLAFVRILAVGIFGFIFITIVNEPPHT

SEQ ID NO: 28916 - protein, 30 aa, artificial
  peptide fold or domain or sub-domain
MIYQHEASNKGALHVLKEQTQGRFSAANLA

SEQ ID NO: 28917 - protein, 30 aa, artificial
  peptide fold or domain or sub-domain
MCLKVSFWLRINSSQENENWKFSKNQLLMN

SEQ ID NO: 28918 - protein, 30 aa, artificial
  peptide fold or domain or sub-domain
MRYPLFQTDYQAIKKAAADLSGAAFLKMSA

SEQ ID NO: 28919 - protein, 30 aa, artificial
  peptide fold or domain or sub-domain
MEEIPKLIVVCVINQKKSCPDRLCAKRVDS

SEQ ID NO: 28920 - protein, 30 aa, artificial
  peptide fold or domain or sub-domain
MLAESGGRFKQYFRARKYAHAFNGRNLFLM

SEQ ID NO: 28921 - protein, 30 aa, artificial
  peptide fold or domain or sub-domain
MIKRERERERGMDWSWIAGLLKSRLSRYEH

SEQ ID NO: 28922 - protein, 29 aa, artificial
  peptide fold or domain or sub-domain
MVNSNAGNPKISRFNAYIRSTAPHARSLG

SEQ ID NO: 28923 - protein, 30 aa, artificial
  peptide fold or domain or sub-domain
MALFGSVTHCLEALLALTCSVSRKNRHQKR

SEQ ID NO: 28924 - protein, 30 aa, artificial
  peptide fold or domain or sub-domain
MVAVIGYVANMLSLMSIQQIGIKQRFILHL

SEQ ID NO: 28925 - protein, 30 aa, artificial
  peptide fold or domain or sub-domain
MESLDVLAAGTVVDAATCDANASHALHTSL

SEQ ID NO: 28926 - protein, 30 aa, artificial
  peptide fold or domain or sub-domain
MMVSVNAYSHPIARLYAQDIEPLSHGYRLT

SEQ ID NO: 28927 - protein, 30 aa, artificial
  peptide fold or domain or sub-domain
MGFYLSSLGLEFCLKESERSFRDSFIALIP

SEQ ID NO: 28928 - protein, 30 aa, artificial
  peptide fold or domain or sub-domain
MGGSFFANKGKMIFTYLQDIGKSAPKISTS

SEQ ID NO: 28929 - protein, 30 aa, artificial
  peptide fold or domain or sub-domain
MGGVKMAVSVPQELGNANATPRNALIARHL

SEQ ID NO: 28930 - protein, 30 aa, artificial
  peptide fold or domain or sub-domain
MIRVGANLEAQVALCNTQGSGISYGQDYLC

SEQ ID NO: 28931 - protein, 30 aa, artificial
  peptide fold or domain or sub-domain
MPINPLDISGGALPEKGIKKGAERRPRQGL

SEQ ID NO: 28932 - protein, 30 aa, artificial
  peptide fold or domain or sub-domain
MKIPVTVVMFGWRSLLDVAIFLFYMEILFL

SEQ ID NO: 28933 - protein, 30 aa, artificial
  peptide fold or domain or sub-domain
MLQRLHCCGKIAANSYRHTWMIVILAANNN

SEQ ID NO: 28934 - protein, 30 aa, artificial
  peptide fold or domain or sub-domain
MTQPGRALSIRQLRNKKTRQATGENILLMQ

SEQ ID NO: 28935 - protein, 30 aa, artificial
  peptide fold or domain or sub-domain
MAGALACGARTRSNRFIRGGDAAPINLNLF

SEQ ID NO: 28936 - protein, 30 aa, artificial
  peptide fold or domain or sub-domain
MVFRMRLFQRKLIANAFLKAHVVPNKNNML

SEQ ID NO: 28937 - protein, 30 aa, artificial
  peptide fold or domain or sub-domain
MTGGKMMPAEGLRPHVTAQQRLLRHTPGGI

SEQ ID NO: 28938 - protein, 30 aa, artificial
  peptide fold or domain or sub-domain
MRLDIHDRIEFCHEFVVSFFVEALNLLMAH

SEQ ID NO: 28939 - protein, 30 aa, artificial
  peptide fold or domain or sub-domain
MASAHLPAPFGESIIIQSRDVIQKSRGVNV

SEQ ID NO: 28940 - protein, 30 aa, artificial
  peptide fold or domain or sub-domain
MSTKLNPYQAQACRQHYIRHKYVCRSMAHG

SEQ ID NO: 28941 - protein, 30 aa, artificial
  peptide fold or domain or sub-domain
MHYILVTGLGENFFYRIYPQEYRAARGNAA

SEQ ID NO: 28942 - protein, 30 aa, artificial
  peptide fold or domain or sub-domain
MLCVAHLHAVRQRIGWYMPSDYHAVTAFVS

SEQ ID NO: 28943 - protein, 30 aa, artificial
  peptide fold or domain or sub-domain
MKHRMLFQLPQHAAVLSCRDNNPRFRFEKG

SEQ ID NO: 28944 - protein, 30 aa, artificial
  peptide fold or domain or sub-domain
MQDGLFLCADNVTCITDKALPGDTLPACPV

SEQ ID NO: 28945 - protein, 30 aa, artificial
  peptide fold or domain or sub-domain
MIKGACGRLFLYLFPVMSFFGKHVHLIGVL

SEQ ID NO: 28946 - protein, 30 aa, artificial
  peptide fold or domain or sub-domain
MTNLQLQMVFFSVFHNDTSIIACKNVIIGA

SEQ ID NO: 28947 - protein, 30 aa, artificial
  peptide fold or domain or sub-domain
MVLIDEHREQDLARVGQHPGRDRDALNGVG

SEQ ID NO: 28948 - protein, 30 aa, artificial
  peptide fold or domain or sub-domain
MMKAVVLRLPFLYAENPPLGWGVKLKNIEL

SEQ ID NO: 28949 - protein, 30 aa, artificial
  peptide fold or domain or sub-domain
MLPRHQKHNAHNPAAGSFPPTYNAYAVPVD

SEQ ID NO: 28950 - protein, 30 aa, artificial
  peptide fold or domain or sub-domain
MEQYPCVRYLMASVPALPLFFAVNTHVLYD

SEQ ID NO: 28951 - protein, 30 aa, artificial
  peptide fold or domain or sub-domain
MFAENFLLWHPARRDGDVPLICGDVPGCKA

SEQ ID NO: 28952 - protein, 28 aa, artificial
  peptide fold or domain or sub-domain
MCNLQPNMSRWAFFAKSVGTWNKSSCRS

SEQ ID NO: 28953 - protein, 30 aa, artificial
  peptide fold or domain or sub-domain
MVIKKEYLTKEEQALLDQTPIKLDPWDALQ

SEQ ID NO: 28954 - protein, 26 aa, artificial
  peptide fold or domain or sub-domain
MGIMAGLAMIPILWLTGKGSSRSTFK

SEQ ID NO: 28955 - protein, 18 aa, artificial
  peptide fold or domain or sub-domain
MTVSHRLTFGVNRKEAHV

SEQ ID NO: 28956 - protein, 27 aa, artificial
  peptide fold or domain or sub-domain
MKVDYEIETFSLSLASANRFTGIVIAS

SEQ ID NO: 28957 - protein, 23 aa, artificial
  peptide fold or domain or sub-domain
MKKVAEEGGFFCGQKKQDLHNML

SEQ ID NO: 28958 - protein, 25 aa, artificial
  peptide fold or domain or sub-domain
MLILLTEKVCPILDQPFLAQQDDTL

SEQ ID NO: 28959 - protein, 30 aa, artificial
  peptide fold or domain or sub-domain
MQFFTGIRNGLLLALPIWGVLILVMSSWLY

SEQ ID NO: 28960 - protein, 25 aa, artificial
  peptide fold or domain or sub-domain
MNDQLVGRLTDVASRRNMPAEARFK

SEQ ID NO: 28961 - protein, 27 aa, artificial
  peptide fold or domain or sub-domain
MKIERPLIMKLCSTHLKMTQRVEPNID

SEQ ID NO: 28962 - protein, 22 aa, artificial
  peptide fold or domain or sub-domain
MMTMQRVAFNFFFKKPRIRLVD

SEQ ID NO: 28963 - protein, 29 aa, artificial
  peptide fold or domain or sub-domain
MIKNRLLILDKLNISVVSITFKKWRHYSK

SEQ ID NO: 28964 - protein, 28 aa, artificial
  peptide fold or domain or sub-domain
MLAENITNHFDDVESGVKNLMSKEDSKD

SEQ ID NO: 28965 - protein, 30 aa, artificial
  peptide fold or domain or sub-domain
MPKFIYLYLKKFGLKRYKEKFLDFLKDHCL

SEQ ID NO: 28966 - protein, 30 aa, artificial
  peptide fold or domain or sub-domain
MVMKQANLKKERVFNRSFFKYQMQGVVKNG

SEQ ID NO: 28967 - protein, 30 aa, artificial
  peptide fold or domain or sub-domain
MVISGVSSVVGFSFVPTFTDGCGLWFSPTT

SEQ ID NO: 28968 - protein, 30 aa, artificial
  peptide fold or domain or sub-domain
MKVDTITNIVYNMIKRKFWKKYYLTKRQVA

SEQ ID NO: 28969 - protein, 30 aa, artificial
  peptide fold or domain or sub-domain
MQLKDINIKNFLDCEGIFKFMSKINNKNSV

SEQ ID NO: 28970 - protein, 30 aa, artificial
  peptide fold or domain or sub-domain
MVALKGGIGVRVIYIPLPGILKSIIKLFLK

SEQ ID NO: 28971 - protein, 30 aa, artificial
  peptide fold or domain or sub-domain
MNITFTEEAKKYLEGKNDTIRIEFMAYGGG

SEQ ID NO: 28972 - protein, 30 aa, artificial
  peptide fold or domain or sub-domain
MLKRKMPLLSRMIDKFSGKIRKNRIKGVIK

SEQ ID NO: 28973 - protein, 30 aa, artificial
  peptide fold or domain or sub-domain
MPGALYPGSKVVPRKVPLSPLGERGFFYNG

SEQ ID NO: 28974 - protein, 30 aa, artificial
  peptide fold or domain or sub-domain
MASKIKGMGKTKSKLIEEVLGVVHLIGILL

SEQ ID NO: 28975 - protein, 30 aa, artificial
  peptide fold or domain or sub-domain
MEIRKQKIIILTQKSVVVKGRLGKRRFFSF

SEQ ID NO: 28976 - protein, 26 aa, artificial
  peptide fold or domain or sub-domain
MLGPLNLSQIINDCYIAIVFYSKANA

SEQ ID NO: 28977 - protein, 28 aa, artificial
  peptide fold or domain or sub-domain
MVILDTLQGCTRIDVHDTSTGKGNVPSY

SEQ ID NO: 28978 - protein, 29 aa, artificial
  peptide fold or domain or sub-domain
MPAQRANVESVVAFAFHWQPLEAERNYYG

SEQ ID NO: 28979 - protein, 30 aa, artificial
  peptide fold or domain or sub-domain
MPAKPAIGSRGRRIPPHRPAERHSRSYRHA

SEQ ID NO: 28980 - protein, 30 aa, artificial
  peptide fold or domain or sub-domain
MRGDALDTVGCRVCAPHAARTGFVIVECGP

SEQ ID NO: 28981 - protein, 30 aa, artificial
  peptide fold or domain or sub-domain
MWGDARVRPRRAAHRPTARYFAPTTLSALL

SEQ ID NO: 28982 - protein, 30 aa, artificial
  peptide fold or domain or sub-domain
MNFIEGPWSARDMMTIDWVNSAASPAFMLS

SEQ ID NO: 28983 - protein, 30 aa, artificial
  peptide fold or domain or sub-domain
MSKERSDRVFQRVLSTYDDAKRLGAGRSVD

SEQ ID NO: 28984 - protein, 30 aa, artificial
  peptide fold or domain or sub-domain
MLAPGDGNAHAFPRMADTIARMHASRCSHR

SEQ ID NO: 28985 - protein, 30 aa, artificial
  peptide fold or domain or sub-domain
MCVLAWAIVVCPVAARDSAIRRMVGACLHA

SEQ ID NO: 28986 - protein, 30 aa, artificial
  peptide fold or domain or sub-domain
MVNLLKRADRQPKRLKVWVDAPAVEVRLNR

SEQ ID NO: 28987 - protein, 29 aa, artificial
  peptide fold or domain or sub-domain
MKKFARAAARGRLEAGGWLLIGETSGPGW

SEQ ID NO: 28988 - protein, 30 aa, artificial
  peptide fold or domain or sub-domain
MRVDPDTAIRECALRRIIVDCHIRRYPNDT

SEQ ID NO: 28989 - protein, 30 aa, artificial
  peptide fold or domain or sub-domain
MAQSVSFTHVMAQRHDCINGTVGSNSDLRI

SEQ ID NO: 28990 - protein, 30 aa, artificial
  peptide fold or domain or sub-domain
MREIKEEITTRIRFNSVVETGVPGFIPRKK

SEQ ID NO: 28991 - protein, 30 aa, artificial
  peptide fold or domain or sub-domain
MFKPYASIGTNLLFFEKGERVLRSRNVLGR

SEQ ID NO: 28992 - protein, 30 aa, artificial
  peptide fold or domain or sub-domain
MKAKIHNIRFAKSVMRAGLGQLPCLGAGRY

SEQ ID NO: 28993 - protein, 30 aa, artificial
  peptide fold or domain or sub-domain
MKRALFLPVCFYLVFKAKVRCRNKSNFLPF

SEQ ID NO: 28994 - protein, 30 aa, artificial
  peptide fold or domain or sub-domain
MFCLVINAKLRVLILVVYIKIPRVNGKNVF

SEQ ID NO: 28995 - protein, 30 aa, artificial
  peptide fold or domain or sub-domain
MQNIIAGLYPVLCLNKITGIDRQNHQKGNH

SEQ ID NO: 28996 - protein, 30 aa, artificial
  peptide fold or domain or sub-domain
MSLQSEKIYLNIVLVTRYKTGFIPGPFRCF

SEQ ID NO: 28997 - protein, 30 aa, artificial
  peptide fold or domain or sub-domain
MFYIRQTAKEGVKQRAGYYPARPFPLSPRR

SEQ ID NO: 28998 - protein, 30 aa, artificial
  peptide fold or domain or sub-domain
MLGIDYSTVIDPFLRGVRRFTTRIRGYKAG

SEQ ID NO: 28999 - protein, 30 aa, artificial
  peptide fold or domain or sub-domain
MTQYLVSIVVQARNYSYFVPYFYKVSAVKF

SEQ ID NO: 29000 - protein, 30 aa, artificial
  peptide fold or domain or sub-domain
MSLTYKAKATLPALQVMWLLKTMMLNKRCA

SEQ ID NO: 29001 - protein, 24 aa, artificial
  peptide fold or domain or sub-domain
MHIFNSIIINLLVVVILKSSRGFC

SEQ ID NO: 29002 - protein, 30 aa, artificial
  peptide fold or domain or sub-domain
MHYQIETPNFIFKKALSIAKLITLFYESLY

SEQ ID NO: 29003 - protein, 29 aa, artificial
  peptide fold or domain or sub-domain
MPEIDQGMVNNIVQVTKIVRLSGVDSLTR

SEQ ID NO: 29004 - protein, 23 aa, artificial
  peptide fold or domain or sub-domain
MTHMTKLIKHIKNNLLLALIVRG

SEQ ID NO: 29005 - protein, 30 aa, artificial
  peptide fold or domain or sub-domain
MGWLPFDHFNWASEYLTLMKFYKLSDGKTN

SEQ ID NO: 29006 - protein, 30 aa, artificial
  peptide fold or domain or sub-domain
MLNSRQIDASIASLLQVNLTQKSVKVVARE

SEQ ID NO: 29007 - protein, 30 aa, artificial
  peptide fold or domain or sub-domain
MYDLFVRTVSIELKAQSDHNSYGTLGAIAP

SEQ ID NO: 29008 - protein, 27 aa, artificial
  peptide fold or domain or sub-domain
MIFKTTILNVVLIVVVVLSPLAGIACA

SEQ ID NO: 29009 - protein, 30 aa, artificial
  peptide fold or domain or sub-domain
MSEKPFILVRSLVAALLIKVNALLQYAFYL

SEQ ID NO: 29010 - protein, 30 aa, artificial
  peptide fold or domain or sub-domain
MGRNISPVLYRFYFRDFKYFLVSLAGFEYQ

SEQ ID NO: 29011 - protein, 30 aa, artificial
  peptide fold or domain or sub-domain
MKKRAQNGLFKYESERKEASSYQGFASTIK

SEQ ID NO: 29012 - protein, 30 aa, artificial
  peptide fold or domain or sub-domain
MYFNLALNNIFELPNLGLLPTKIFGHNEIK

SEQ ID NO: 29013 - protein, 30 aa, artificial
  peptide fold or domain or sub-domain
MPLGYISAMDKNEFIIFVCIYLIDNLLIAL

SEQ ID NO: 29014 - protein, 30 aa, artificial
  peptide fold or domain or sub-domain
MTLTFFSPFLRLKFMLLTLAFKVNIRRTIY

SEQ ID NO: 29015 - protein, 30 aa, artificial
  peptide fold or domain or sub-domain
MFFVQANCSVNDLSEVMNNDTQPYTVTCHD

SEQ ID NO: 29016 - protein, 30 aa, artificial
  peptide fold or domain or sub-domain
MNNIRFATNKYDHFVRKGEAMSELTDTSAT

SEQ ID NO: 29017 - protein, 30 aa, artificial
  peptide fold or domain or sub-domain
MQIQEHIQEHIQEHIQGDISQVFRSLVGLV

SEQ ID NO: 29018 - protein, 30 aa, artificial
  peptide fold or domain or sub-domain
MLISVRIIRFSNHNFERILEALMLFLDVLA

SEQ ID NO: 29019 - protein, 30 aa, artificial
  peptide fold or domain or sub-domain
MLFKRLILFAFNLLLNSGITWGAVYSFIRH

SEQ ID NO: 29020 - protein, 30 aa, artificial
  peptide fold or domain or sub-domain
MITYLQMSNTLTNKEATTMPKIFIFKYKKL

SEQ ID NO: 29021 - protein, 30 aa, artificial
  peptide fold or domain or sub-domain
MLTGELGRLCGESNYVSNVATAVILWRYIF

SEQ ID NO: 29022 - protein, 30 aa, artificial
  peptide fold or domain or sub-domain
MYFKEFWYEAFSASLSAIFTGEDNNFLIRE

SEQ ID NO: 29023 - protein, 30 aa, artificial
  peptide fold or domain or sub-domain
MAYLLVLPFNHTIAIASNNRNYGKCNYYFE

SEQ ID NO: 29024 - protein, 30 aa, artificial
  peptide fold or domain or sub-domain
MPIFIIHITLLSLTLNGNLRELGESNMKQR

SEQ ID NO: 29025 - protein, 30 aa, artificial
  peptide fold or domain or sub-domain
MVTDSSIMLEWLIKATSILLVTTKLKIEIK

SEQ ID NO: 29026 - protein, 30 aa, artificial
  peptide fold or domain or sub-domain
MTKLGYYLPKMVTGIDGIPTFFTYAGTLTR

SEQ ID NO: 29027 - protein, 30 aa, artificial
  peptide fold or domain or sub-domain
MHLINSASKTLPDYRYIFLTSKVYLKKYCR

SEQ ID NO: 29028 - protein, 30 aa, artificial
  peptide fold or domain or sub-domain
MGVLPFYLSSVEFHPKSILSEQGHQLLDHF

SEQ ID NO: 29029 - protein, 30 aa, artificial
  peptide fold or domain or sub-domain
MPLPEYIRLLCHSASEVERCYADCCVTDVS

SEQ ID NO: 29030 - protein, 30 aa, artificial
  peptide fold or domain or sub-domain
MHKNSSIEYIPVTIEYAFSRVLDMFQLKAL

SEQ ID NO: 29031 - protein, 30 aa, artificial
  peptide fold or domain or sub-domain
MERVYSRINSKPLEIKQFNQFSLIKIVKRT

SEQ ID NO: 29032 - protein, 30 aa, artificial
  peptide fold or domain or sub-domain
MLDLNTLFILTMIPASALFLISMVVGVFES

SEQ ID NO: 29033 - protein, 30 aa, artificial
  peptide fold or domain or sub-domain
MFIATTSQYEVVAKLSLNWPVPQKTDHLKK

SEQ ID NO: 29034 - protein, 30 aa, artificial
  peptide fold or domain or sub-domain
MGVTGFSSSLDGKYSQVNISDVSRYAIGAR

SEQ ID NO: 29035 - protein, 30 aa, artificial
  peptide fold or domain or sub-domain
MKYDDKCPSGFWQVCRFIENDAWEMSKTCT

SEQ ID NO: 29036 - protein, 30 aa, artificial
  peptide fold or domain or sub-domain
MNARDFLGLSKKARHARACRVVFSSSGREA

SEQ ID NO: 29037 - protein, 30 aa, artificial
  peptide fold or domain or sub-domain
MAQEILLAMQCKIFGSLNMGKAAEHVQGVH

SEQ ID NO: 29038 - protein, 30 aa, artificial
  peptide fold or domain or sub-domain
MQICLPRGLHAIFCKERAAFEWDVAYLKVR

SEQ ID NO: 29039 - protein, 30 aa, artificial
  peptide fold or domain or sub-domain
MIAENASAEIPSSRTGEASPLRFHALGAEA

SEQ ID NO: 29040 - protein, 30 aa, artificial
  peptide fold or domain or sub-domain
MACGVMALHIVRRQDWHLQLIATRSIPALF

SEQ ID NO: 29041 - protein, 30 aa, artificial
  peptide fold or domain or sub-domain
MSFKPQANGSALIACDHDFLQLQACNLKLP

SEQ ID NO: 29042 - protein, 30 aa, artificial
  peptide fold or domain or sub-domain
MSCSFKRLAQNTLYLYDYTSSDTAFWLYLT

SEQ ID NO: 29043 - protein, 30 aa, artificial
  peptide fold or domain or sub-domain
MCSRYFNIVYKSTCSYKTQVLKVQANNEHR

SEQ ID NO: 29044 - protein, 29 aa, artificial
  peptide fold or domain or sub-domain
MKNIIQRVFRALAVGYIVKAIRNLISKNK

SEQ ID NO: 29045 - protein, 24 aa, artificial
  peptide fold or domain or sub-domain
MISLISKYVCFVVINFSYEKKALN

SEQ ID NO: 29046 - protein, 25 aa, artificial
  peptide fold or domain or sub-domain
MHQPLTFCNYPAITYFILFSNSVQI

SEQ ID NO: 29047 - protein, 25 aa, artificial
  peptide fold or domain or sub-domain
MKFIFKVFISALLLFLLIGQKNKAQ

SEQ ID NO: 29048 - protein, 25 aa, artificial
  peptide fold or domain or sub-domain
MNNEQIEAFVEVLVPIIEERINKGK

SEQ ID NO: 29049 - protein, 30 aa, artificial
  peptide fold or domain or sub-domain
MIELIANFFQGLVNLIGGALAGLAGLISGK

SEQ ID NO: 29050 - protein, 30 aa, artificial
  peptide fold or domain or sub-domain
MPRNKTRGTSDTAIDTSYQHNLGIQKGWIK

SEQ ID NO: 29051 - protein, 30 aa, artificial
  peptide fold or domain or sub-domain
MIVVLFVMKYIVCPIIVGRVLYLLNQEHKR

SEQ ID NO: 29052 - protein, 11 aa, artificial
  peptide fold or domain or sub-domain
MKMFEENRIVK

SEQ ID NO: 29053 - protein, 23 aa, artificial
  peptide fold or domain or sub-domain
MVSKYIINRNSIATSEMSIMDSI

SEQ ID NO: 29054 - protein, 22 aa, artificial
  peptide fold or domain or sub-domain
MKASYFIFLLNKCRISILKGKI

SEQ ID NO: 29055 - protein, 25 aa, artificial
  peptide fold or domain or sub-domain
MTDVFGFIKKAIDFISSILVHGEPK

SEQ ID NO: 29056 - protein, 25 aa, artificial
  peptide fold or domain or sub-domain
MRMERYFDESIRSANWIGKDVFKYH

SEQ ID NO: 29057 - protein, 28 aa, artificial
  peptide fold or domain or sub-domain
MEIPQAKQAGVGAPAKRISHGNSTKPLF

SEQ ID NO: 29058 - protein, 24 aa, artificial
  peptide fold or domain or sub-domain
MNDLNPQLFNEVKSIFKKFTNDLF

SEQ ID NO: 29059 - protein, 28 aa, artificial
  peptide fold or domain or sub-domain
MSRELRRKLTFYINVVTLLLAMVNFFKK

SEQ ID NO: 29060 - protein, 30 aa, artificial
  peptide fold or domain or sub-domain
MKINRDQISLYLTIGIFILVLLALISSFIN

SEQ ID NO: 29061 - protein, 30 aa, artificial
  peptide fold or domain or sub-domain
MEVFKSIIFKIHLLHYLQLNNQSSYNIKNN

SEQ ID NO: 29062 - protein, 23 aa, artificial
  peptide fold or domain or sub-domain
MAVEYYSMFLPFSLSFFKLYYVI

SEQ ID NO: 29063 - protein, 30 aa, artificial
  peptide fold or domain or sub-domain
MLDSNWIQSCSFFKSNNYIFITKSDTLNPY

SEQ ID NO: 29064 - protein, 30 aa, artificial
  peptide fold or domain or sub-domain
MQNVKPLQQVAFFINTDMTSIECNKKVSYD

SEQ ID NO: 29065 - protein, 19 aa, artificial
  peptide fold or domain or sub-domain
MQKRNLYINILVYKLQLTQ

SEQ ID NO: 29066 - protein, 14 aa, artificial
  peptide fold or domain or sub-domain
MRSSKYYLLVVKPT

SEQ ID NO: 29067 - protein, 15 aa, artificial
  peptide fold or domain or sub-domain
MYLQNTIKLGTSLIY

SEQ ID NO: 29068 - protein, 25 aa, artificial
  peptide fold or domain or sub-domain
MIFIPNISDIEDIETLFSDIKNDLR

SEQ ID NO: 29069 - protein, 22 aa, artificial
  peptide fold or domain or sub-domain
MKIHILTFVKTVVIEDTVAIVN

SEQ ID NO: 29070 - protein, 30 aa, artificial
  peptide fold or domain or sub-domain
MRKQRDNHSAYVFIKRLIKQFGKPQKVITD

SEQ ID NO: 29071 - protein, 30 aa, artificial
  peptide fold or domain or sub-domain
MKANNKICWLFLYPEGETPLMGGFSFFISI

SEQ ID NO: 29072 - protein, 30 aa, artificial
  peptide fold or domain or sub-domain
MQQYIGSLLQELFNIILESHKISTLFNYSK

SEQ ID NO: 29073 - protein, 29 aa, artificial
  peptide fold or domain or sub-domain
MRCEMEGTNIVLHHIVPRVQRVRAEHPFY

SEQ ID NO: 29074 - protein, 30 aa, artificial
  peptide fold or domain or sub-domain
MVKKIANRTAFVTKNLLLRHNSFVKIAPVW

SEQ ID NO: 29075 - protein, 29 aa, artificial
  peptide fold or domain or sub-domain
MIVTTAQYYGIKTEENGTVHCLVSYGICQ

SEQ ID NO: 29076 - protein, 29 aa, artificial
  peptide fold or domain or sub-domain
MNAVVCLFTDEKCARKAYYNLSITDICDE

SEQ ID NO: 29077 - protein, 30 aa, artificial
  peptide fold or domain or sub-domain
MVLAFKGCMDDYLLQYKENYNSSKVFFMFV

SEQ ID NO: 29078 - protein, 30 aa, artificial
  peptide fold or domain or sub-domain
MCVYQQQRSFFSPTEFQTIHFDSYTNSNQL

SEQ ID NO: 29079 - protein, 30 aa, artificial
  peptide fold or domain or sub-domain
MNAHGHSLIFQKMIVHAFAFFSKQKNYLYF

SEQ ID NO: 29080 - protein, 30 aa, artificial
  peptide fold or domain or sub-domain
MPKARPVNHNKKKSKITIKSNFTLFYMFNP

SEQ ID NO: 29081 - protein, 30 aa, artificial
  peptide fold or domain or sub-domain
MAQAKFNEPMTNEEKNLLNRHAEWLDEFMK

SEQ ID NO: 29082 - protein, 27 aa, artificial
  peptide fold or domain or sub-domain
MNILFGIIGFVVAMTAAVIVTAISIAK

SEQ ID NO: 29083 - protein, 30 aa, artificial
  peptide fold or domain or sub-domain
MLLAMINFKKLKIDNVFEHIFSEKQVMMLY

SEQ ID NO: 29084 - protein, 30 aa, artificial
  peptide fold or domain or sub-domain
MKLNTLNKKDNPSLNDQDKNAVLNLLALAK

SEQ ID NO: 29085 - protein, 21 aa, artificial
  peptide fold or domain or sub-domain
MTADFFQLIGSLFRILKELFK

SEQ ID NO: 29086 - protein, 30 aa, artificial
  peptide fold or domain or sub-domain
MTSCDKTIKKDHIPDKGRGLRVATLFNNFK

SEQ ID NO: 29087 - protein, 30 aa, artificial
  peptide fold or domain or sub-domain
MNFALLYRLHEYNLINNELKNRIMNKKALN

SEQ ID NO: 29088 - protein, 30 aa, artificial
  peptide fold or domain or sub-domain
MINDVQVHQNSIILHDSKITKSFLGVYRMS

SEQ ID NO: 29089 - protein, 30 aa, artificial
  peptide fold or domain or sub-domain
MHSFIPPIKVIEPFSQIRNFEAMASHKHYY

SEQ ID NO: 29090 - protein, 30 aa, artificial
  peptide fold or domain or sub-domain
MATVFSIIDINNDLRAMTQIFRKSSRKIVV

SEQ ID NO: 29091 - protein, 30 aa, artificial
  peptide fold or domain or sub-domain
MVILVFSLIFIFTDNYLVYQSKSIKEDVMI

SEQ ID NO: 29092 - protein, 30 aa, artificial
  peptide fold or domain or sub-domain
MEHVLPFQNTPPNIVIIYKDFTHLKSITFS

SEQ ID NO: 29093 - protein, 30 aa, artificial
  peptide fold or domain or sub-domain
MSELTHELLPLNCKERHIVTRLYEVITLRI

SEQ ID NO: 29094 - protein, 30 aa, artificial
  peptide fold or domain or sub-domain
MNKYKTIAIVKKQLRHIIYYFDYLFKTRNH

SEQ ID NO: 29095 - protein, 30 aa, artificial
  peptide fold or domain or sub-domain
MILVCAAVIWGRVLFILKFPIYFSIRLAFL

SEQ ID NO: 29096 - protein, 30 aa, artificial
  peptide fold or domain or sub-domain
MIDKKISRGFLLYTVHKTLSAYSLKRPQLF

SEQ ID NO: 29097 - protein, 30 aa, artificial
  peptide fold or domain or sub-domain
MERKLTLRDFGHEIIKKDLHLDPFKLKMKF

SEQ ID NO: 29098 - protein, 29 aa, artificial
  peptide fold or domain or sub-domain
MLSPLGLFALIGIEQRVKFFADFHGRRRV

SEQ ID NO: 29099 - protein, 27 aa, artificial
  peptide fold or domain or sub-domain
MTIMQFSQMKKQKNLSNIVEKNFKKSS

SEQ ID NO: 29100 - protein, 30 aa, artificial
  peptide fold or domain or sub-domain
MKKNSWNILLKVIIAVASAIAGVIGGQGLL

SEQ ID NO: 29101 - protein, 30 aa, artificial
  peptide fold or domain or sub-domain
MMSVRRNTDQVIVIASYQAGVKARRLSGYR

SEQ ID NO: 29102 - protein, 29 aa, artificial
  peptide fold or domain or sub-domain
MTDTQVFVALLLALVPAVLAYRLGTELYR

SEQ ID NO: 29103 - protein, 28 aa, artificial
  peptide fold or domain or sub-domain
REWTCVACGSTHDRDINASRNILGRGRA

SEQ ID NO: 29104 - protein, 23 aa, artificial
  peptide fold or domain or sub-domain
MNLVKIIYELKLPKRFLQKNKYI

SEQ ID NO: 29105 - protein, 30 aa, artificial
  peptide fold or domain or sub-domain
MKVTCFNISKLTYESRLRYLLFKNLDQAEN

SEQ ID NO: 29106 - protein, 29 aa, artificial
  peptide fold or domain or sub-domain
MKRKSAYSPSAREKLAFKVPTRRSGLGGV

SEQ ID NO: 29107 - protein, 30 aa, artificial
  peptide fold or domain or sub-domain
MAEASPYGSMETAPGVGSGSCRLRPWMRVT

SEQ ID NO: 29108 - protein, 30 aa, artificial
  peptide fold or domain or sub-domain
MAIQCFPGMHVSKKTYLGMQRKMKSGACNS

SEQ ID NO: 29109 - protein, 30 aa, artificial
  peptide fold or domain or sub-domain
MSGGSARRAQAMRRRSGREQTHRHTEISKY

SEQ ID NO: 29110 - protein, 30 aa, artificial
  peptide fold or domain or sub-domain
MSWMLWLAGASTFLLFAYLVYALLRAEDIE

SEQ ID NO: 29111 - protein, 30 aa, artificial
  peptide fold or domain or sub-domain
MQKSPKGKQGKAENPIHTGLVHPAQTIRSP

SEQ ID NO: 29112 - protein, 29 aa, artificial
  peptide fold or domain or sub-domain
MTMCGLTLTMFAYMSEKRQVKEDMWGTDL

SEQ ID NO: 29113 - protein, 29 aa, artificial
  peptide fold or domain or sub-domain
MVNDIHLPTAASHAKPVILKGDTLHEAGL

SEQ ID NO: 29114 - protein, 30 aa, artificial
  peptide fold or domain or sub-domain
MDGAGEMFFHLNTSKVRLQKCYFLNVGVFQ

SEQ ID NO: 29115 - protein, 30 aa, artificial
  peptide fold or domain or sub-domain
MHIDFLIKSQTTLLPIGHSELCQNNVYILG

SEQ ID NO: 29116 - protein, 30 aa, artificial
  peptide fold or domain or sub-domain
MSMSKYLAQNFQIFNRTFMFKKIVQWLLSS

SEQ ID NO: 29117 - protein, 30 aa, artificial
  peptide fold or domain or sub-domain
MLINIHYSQVLRKQTALLTNAKVRSFFRKF

SEQ ID NO: 29118 - protein, 30 aa, artificial
  peptide fold or domain or sub-domain
MALLSTLSDRKSAVKKTEILNYAFVQSSTS

SEQ ID NO: 29119 - protein, 30 aa, artificial
  peptide fold or domain or sub-domain
MREAKSAILFFTGLISNIFLFLSCQNKPQL

SEQ ID NO: 29120 - protein, 30 aa, artificial
  peptide fold or domain or sub-domain
MITKQMSEVLQQNCGKNYRTLYLFFSVKYG

SEQ ID NO: 29121 - protein, 30 aa, artificial
  peptide fold or domain or sub-domain
MHSLTANCVSWGKTSKLNRILLNYLYKEKS

SEQ ID NO: 29122 - protein, 30 aa, artificial
  peptide fold or domain or sub-domain
MNKSRFAFQLIKSVVIVGATISQIQKKSSN

SEQ ID NO: 29123 - protein, 30 aa, artificial
  peptide fold or domain or sub-domain
MKDERNFYEKNNYCDFACHSNRTFNQCLGG

SEQ ID NO: 29124 - protein, 30 aa, artificial
  peptide fold or domain or sub-domain
MEKIVSLLIIPAIWVKKCGYFRRSFDFFQL

SEQ ID NO: 29125 - protein, 30 aa, artificial
  peptide fold or domain or sub-domain
MLKKYRTFIKVRYFYIKFFETPVSPDFYTK

SEQ ID NO: 29126 - protein, 30 aa, artificial
  peptide fold or domain or sub-domain
MQGLLLDEPLERSNVLSTKWTPKAQKCGQF

SEQ ID NO: 29127 - protein, 30 aa, artificial
  peptide fold or domain or sub-domain
MPDKFHNFSSRIVKFVFIYNKNLVKNDRTL

SEQ ID NO: 29128 - protein, 30 aa, artificial
  peptide fold or domain or sub-domain
MCGLQEELQKRLGIEEKIVHYYVLIRLSMN

SEQ ID NO: 29129 - protein, 27 aa, artificial
  peptide fold or domain or sub-domain
MFKIFYGINIEIPRSKRINSLKEVDNL

SEQ ID NO: 29130 - protein, 30 aa, artificial
  peptide fold or domain or sub-domain
MQNAQIRLLDIIAYERVVFSEIQLLNNCAK

SEQ ID NO: 29131 - protein, 30 aa, artificial
  peptide fold or domain or sub-domain
MANVIGAAVLSSVLQVIFSIVVLRRPMPRF

SEQ ID NO: 29132 - protein, 30 aa, artificial
  peptide fold or domain or sub-domain
MAEGRAKPMLTICNAGGFARAFVRSFKGSC

SEQ ID NO: 29133 - protein, 24 aa, artificial
  peptide fold or domain or sub-domain
MELNNSSMEAHFVSVEKNQDSEKI

SEQ ID NO: 29134 - protein, 30 aa, artificial
  peptide fold or domain or sub-domain
MLLIANPVEHNWIVVDEAGLVMIAPEKKFP

SEQ ID NO: 29135 - protein, 25 aa, artificial
  peptide fold or domain or sub-domain
MTTWTWIGASGQFGIRVPNGNVTTY

SEQ ID NO: 29136 - protein, 30 aa, artificial
  peptide fold or domain or sub-domain
MSMAGSASDVARLDPEHGWRFVIDNAFGTA

SEQ ID NO: 29137 - protein, 28 aa, artificial
  peptide fold or domain or sub-domain
MEASHRGALNYNEARLKKDGVVMSLTVQ

SEQ ID NO: 29138 - protein, 30 aa, artificial
  peptide fold or domain or sub-domain
MIAENVPAFDANVDSSSTRQVFYAQYQAVC

SEQ ID NO: 29139 - protein, 30 aa, artificial
  peptide fold or domain or sub-domain
MKSTELKAEEIRLITNINKKIKQVVNHLYV

SEQ ID NO: 29140 - protein, 30 aa, artificial
  peptide fold or domain or sub-domain
MLHYEVTLVMKGVPARSCYLSNRIVGLHES

SEQ ID NO: 29141 - protein, 30 aa, artificial
  peptide fold or domain or sub-domain
MVARIHLIKFKVVIKSKKRHSNECLFLWTK

SEQ ID NO: 29142 - protein, 30 aa, artificial
  peptide fold or domain or sub-domain
MSFKSIQELKDHRERNEGSGKSKCIASYWV

SEQ ID NO: 29143 - protein, 30 aa, artificial
  peptide fold or domain or sub-domain
MQPFLRDFQLGVLENNAYMIFNIKVFLSEK

SEQ ID NO: 29144 - protein, 30 aa, artificial
  peptide fold or domain or sub-domain
MVDIDVALGNLINIVSQQSEKWQRTNQASK

SEQ ID NO: 29145 - protein, 30 aa, artificial
  peptide fold or domain or sub-domain
MEKINWILNRIISFLLIVHSTFLFIFKVEC

SEQ ID NO: 29146 - protein, 26 aa, artificial
  peptide fold or domain or sub-domain
MDIDVNKLLQAFVYFKSCEKLRHNNS

SEQ ID NO: 29147 - protein, 30 aa, artificial
  peptide fold or domain or sub-domain
MDKDRIISFFIYELLFYSASLNRGSVSISS

SEQ ID NO: 29148 - protein, 30 aa, artificial
  peptide fold or domain or sub-domain
MILEVGFGEVRKSSALLWKNKAQIKTAPFP

SEQ ID NO: 29149 - protein, 30 aa, artificial
  peptide fold or domain or sub-domain
MSTPFKAPCPARNLLETVEKSHCYVATCDS

SEQ ID NO: 29150 - protein, 30 aa, artificial
  peptide fold or domain or sub-domain
MEIPAHHWTFVWKQLDFEPKFLRNLTTIER

SEQ ID NO: 29151 - protein, 29 aa, artificial
  peptide fold or domain or sub-domain
MDLLDIIGLICAAALYLYVGYALLFPERF

SEQ ID NO: 29152 - protein, 18 aa, artificial
  peptide fold or domain or sub-domain
MAIGSPRQYLLRGDTPHT

SEQ ID NO: 29153 - protein, 30 aa, artificial
  peptide fold or domain or sub-domain
MSYILARCMVVQRELWRNRTWNWRLCFSIC

SEQ ID NO: 29154 - protein, 30 aa, artificial
  peptide fold or domain or sub-domain
MVASPCGTCFGCVPCACFPRELLSWQVVAA

SEQ ID NO: 29155 - protein, 29 aa, artificial
  peptide fold or domain or sub-domain
MRIYYLKLQSYCIKVEICDGSGKLGKSMD

SEQ ID NO: 29156 - protein, 30 aa, artificial
  peptide fold or domain or sub-domain
MLKYSSNSNFAASFFDNGIKFIASSRLLIC

SEQ ID NO: 29157 - protein, 21 aa, artificial
  peptide fold or domain or sub-domain
MSACAEYAIFHMEDKPCQGVT

SEQ ID NO: 29158 - protein, 30 aa, artificial
  peptide fold or domain or sub-domain
MLNKRLSSYDNIKRKNDINGGEWVRGGMDF

SEQ ID NO: 29159 - protein, 30 aa, artificial
  peptide fold or domain or sub-domain
MFIIFMITYRLKVLKRWDDFPQMFDLSLFV

SEQ ID NO: 29160 - protein, 30 aa, artificial
  peptide fold or domain or sub-domain
MRGFNIWITLIRLCSQENEVLFSIFLITFV

SEQ ID NO: 29161 - protein, 30 aa, artificial
  peptide fold or domain or sub-domain
MIYMALLELYVIYGAVVLDFIEGIAEKGVE

SEQ ID NO: 29162 - protein, 30 aa, artificial
  peptide fold or domain or sub-domain
MYVRREYIKMIGYKFFVMQAEEWRYDDENI

SEQ ID NO: 29163 - protein, 30 aa, artificial
  peptide fold or domain or sub-domain
MNIFLINSKVAIVVPYIELYGINKEGGAKE

SEQ ID NO: 29164 - protein, 30 aa, artificial
  peptide fold or domain or sub-domain
MGDLFSFFTLSNEIYNLRNTSYIRVKGDAI

SEQ ID NO: 29165 - protein, 30 aa, artificial
  peptide fold or domain or sub-domain
MEEQKRYGYFPHLFCPLLFINKAYQQNFTC

SEQ ID NO: 29166 - protein, 30 aa, artificial
  peptide fold or domain or sub-domain
MGKKIETNEFFMLKMIKGVEKNYILEWIKF

SEQ ID NO: 29167 - protein, 30 aa, artificial
  peptide fold or domain or sub-domain
MNYITISITITRKQNDYFTLIELTLLKLKG

SEQ ID NO: 29168 - protein, 30 aa, artificial
  peptide fold or domain or sub-domain
MRFARVAGVDESITEEYIYIILFGDKKTFK

SEQ ID NO: 29169 - protein, 30 aa, artificial
  peptide fold or domain or sub-domain
MHIFYHLFFSFISIFEENAVLFAPFLSCVK

SEQ ID NO: 29170 - protein, 30 aa, artificial
  peptide fold or domain or sub-domain
MLLYYKKEQQKHYSFVKINPVYSSKKRSNH

SEQ ID NO: 29171 - protein, 30 aa, artificial
  peptide fold or domain or sub-domain
MKKEYRKIFVDFSTQICIPFIHYKRVLLYV

SEQ ID NO: 29172 - protein, 30 aa, artificial
  peptide fold or domain or sub-domain
MFKQLLRNIFLLPSINKGITVKGGTFTPGI

SEQ ID NO: 29173 - protein, 30 aa, artificial
  peptide fold or domain or sub-domain
MILAHKVPLIFVFIFFLFIYISVLIFPVTT

SEQ ID NO: 29174 - protein, 30 aa, artificial
  peptide fold or domain or sub-domain
MSVNLSYFSHKYLRNLPNEKKAKEAPSSEF

SEQ ID NO: 29175 - protein, 30 aa, artificial
  peptide fold or domain or sub-domain
MCSNCFGERTEKDSKVKIKLEGRKSSASQE

SEQ ID NO: 29176 - protein, 30 aa, artificial
  peptide fold or domain or sub-domain
MGQILLTLAMQLACNIKLNWRSNNSECFIV

SEQ ID NO: 29177 - protein, 30 aa, artificial
  peptide fold or domain or sub-domain
MKEYVIKTSPKLLCALSIFGVKLKKTFPKH

SEQ ID NO: 29178 - protein, 30 aa, artificial
  peptide fold or domain or sub-domain
MKQSYDKIILQSPFKSFKDWRGFVYARFFV

SEQ ID NO: 29179 - protein, 30 aa, artificial
  peptide fold or domain or sub-domain
MYFHDISFLKSTIADYPVKLRICQYESAAF

SEQ ID NO: 29180 - protein, 30 aa, artificial
  peptide fold or domain or sub-domain
MFYGSKKSAKQQLEKSLLVWIFFSFYNLEK

SEQ ID NO: 29181 - protein, 30 aa, artificial
  peptide fold or domain or sub-domain
MPLIISKAQIKMSGDILGSCFKLFYLRPFF

SEQ ID NO: 29182 - protein, 30 aa, artificial
  peptide fold or domain or sub-domain
MILNKKPKLPLWKLGKNYFRRFYVLPTFLA

SEQ ID NO: 29183 - protein, 30 aa, artificial
  peptide fold or domain or sub-domain
MRMEPLEIYGIVVFFSVANVLFFVYNITDD

SEQ ID NO: 29184 - protein, 30 aa, artificial
  peptide fold or domain or sub-domain
MREKEGVIGGEYSQQSFKAKPCSERGVLSP

SEQ ID NO: 29185 - protein, 30 aa, artificial
  peptide fold or domain or sub-domain
MFFMNFIKNDLNKVMCEFTPPPPPDKFLSI

SEQ ID NO: 29186 - protein, 30 aa, artificial
  peptide fold or domain or sub-domain
MLGFFNNKADLVKADTERDNRMSSLKIKDL

SEQ ID NO: 29187 - protein, 30 aa, artificial
  peptide fold or domain or sub-domain
MTNNKNKVIIKAIKFKNKDFINLDLFIYRR

SEQ ID NO: 29188 - protein, 30 aa, artificial
  peptide fold or domain or sub-domain
MTQPEIKHKKECQKGTNTAFCVLLIFQEVF

SEQ ID NO: 29189 - protein, 30 aa, artificial
  peptide fold or domain or sub-domain
MSSRGNYHNAKFGYEKETSSSVIIPITVPK

SEQ ID NO: 29190 - protein, 30 aa, artificial
  peptide fold or domain or sub-domain
MSFEKNKIENNLKIAQAYIYIKPKPRICQA

SEQ ID NO: 29191 - protein, 30 aa, artificial
  peptide fold or domain or sub-domain
MTINIDDKVLDYLKKINSKAITIDLIGCAS

SEQ ID NO: 29192 - protein, 30 aa, artificial
  peptide fold or domain or sub-domain
MYIEGHISKIILIYKWICKYDMEFSLFADP

SEQ ID NO: 29193 - protein, 30 aa, artificial
  peptide fold or domain or sub-domain
MTGYEYTIAQPKAISIILSKRSEEHSNVLV

SEQ ID NO: 29194 - protein, 30 aa, artificial
  peptide fold or domain or sub-domain
MPLQSLRSCRAITCDSFMVTIFTPLQENQQ

SEQ ID NO: 29195 - protein, 30 aa, artificial
  peptide fold or domain or sub-domain
MWVGSEMFSRVLGIFVSSEVFRLLCVIKCY

SEQ ID NO: 29196 - protein, 30 aa, artificial
  peptide fold or domain or sub-domain
MNELMKYPATLTATATTPGIKYSHLCSVCL

SEQ ID NO: 29197 - protein, 30 aa, artificial
  peptide fold or domain or sub-domain
MKKSHSQGKRKLKDLNSAYKIDNQLHYALR

SEQ ID NO: 29198 - protein, 30 aa, artificial
  peptide fold or domain or sub-domain
MWENKPSPLGSIKKLQGLVYRLIGYRHFWV

SEQ ID NO: 29199 - protein, 30 aa, artificial
  peptide fold or domain or sub-domain
MGRFQISIRGEEKSKVKVQGKGTFTDRNTT

SEQ ID NO: 29200 - protein, 30 aa, artificial
  peptide fold or domain or sub-domain
MYVSADESAYNHIVTDDIPLADRRIEAVQQ

SEQ ID NO: 29201 - protein, 30 aa, artificial
  peptide fold or domain or sub-domain
MVAIPQAGFLWVTDPLMGCLAADFPLEKDR

SEQ ID NO: 29202 - protein, 29 aa, artificial
  peptide fold or domain or sub-domain
MNIALLAIALLVLVCCGFLVIVWVQSENK

SEQ ID NO: 29203 - protein, 30 aa, artificial
  peptide fold or domain or sub-domain
MPFCNLKKAEILNGRLAMIGVIIMILTSFT

SEQ ID NO: 29204 - protein, 30 aa, artificial
  peptide fold or domain or sub-domain
MKLFSFSICANKLLQQNNRTNKYRIFSPYL

SEQ ID NO: 29205 - protein, 30 aa, artificial
  peptide fold or domain or sub-domain
MWVKFCVKCAFLDISFLFQKFAKLCHNITY

SEQ ID NO: 29206 - protein, 30 aa, artificial
  peptide fold or domain or sub-domain
MHSTYKRYIFLQQNKNKQNLLHYRILKNTQ

SEQ ID NO: 29207 - protein, 30 aa, artificial
  peptide fold or domain or sub-domain
MSIIKPDIWYLQGVLSEIIKKLFYQSKIQL

SEQ ID NO: 29208 - protein, 30 aa, artificial
  peptide fold or domain or sub-domain
MQIPNEFYTMLNENTNFAEVRFHIKEFQKV

SEQ ID NO: 29209 - protein, 30 aa, artificial
  peptide fold or domain or sub-domain
MFCKKFVQNNRFLVIYDRLMGGYQWFDKSG

SEQ ID NO: 29210 - protein, 30 aa, artificial
  peptide fold or domain or sub-domain
MRKFYHFFCKYNRLAKQFTDRKQEFTSFIG

SEQ ID NO: 29211 - protein, 30 aa, artificial
  peptide fold or domain or sub-domain
MRELNSVKKKKPNSTFYQNGQTSTLFLTQE

SEQ ID NO: 29212 - protein, 30 aa, artificial
  peptide fold or domain or sub-domain
MPFYKPNYLNISTDTFKFLNKGIYLLQTLP

SEQ ID NO: 29213 - protein, 30 aa, artificial
  peptide fold or domain or sub-domain
MKKSVKKKNEFTNYGRNHIIFLLLFMIRLG

SEQ ID NO: 29214 - protein, 30 aa, artificial
  peptide fold or domain or sub-domain
MDLFQNIKINLDLMDYFHKMELFQFNTTFV

SEQ ID NO: 29215 - protein, 30 aa, artificial
  peptide fold or domain or sub-domain
MQKISEKNRLCYDSCHCGLKNEIFNRLKMT

SEQ ID NO: 29216 - protein, 30 aa, artificial
  peptide fold or domain or sub-domain
MTQNRFIKPTDYFPSLGSQIAVIFGLNLPK

SEQ ID NO: 29217 - protein, 30 aa, artificial
  peptide fold or domain or sub-domain
MHLHNSSFKNSTLYWQCYFFMLNNQPMDKT

SEQ ID NO: 29218 - protein, 30 aa, artificial
  peptide fold or domain or sub-domain
MMTLYPGLNKSVGNQLRSVSGFPAWFSAET

SEQ ID NO: 29219 - protein, 30 aa, artificial
  peptide fold or domain or sub-domain
MAGFIFLLCVFQKNANYTLDENKWTIDNEN

SEQ ID NO: 29220 - protein, 30 aa, artificial
  peptide fold or domain or sub-domain
MSIKVNKWLKLWRKNSKKLEFLENFPNYSE

SEQ ID NO: 29221 - protein, 30 aa, artificial
  peptide fold or domain or sub-domain
MLADLKGCTISNIISLDSTGFFVIFKGLKT

SEQ ID NO: 29222 - protein, 30 aa, artificial
  peptide fold or domain or sub-domain
MRLNFLINTIYQVTAFNRVARVLLRYLKSL

SEQ ID NO: 29223 - protein, 30 aa, artificial
  peptide fold or domain or sub-domain
MVFLWQSQKQAGELGRNQLNFAILRTFLLH

SEQ ID NO: 29224 - protein, 30 aa, artificial
  peptide fold or domain or sub-domain
MFMDKLAKVLLACCGIFLVIGVIYLVVFAK

SEQ ID NO: 29225 - protein, 28 aa, artificial
  peptide fold or domain or sub-domain
MCTYGENAVKEFFKKQELERNIKAARKS

SEQ ID NO: 29226 - protein, 30 aa, artificial
  peptide fold or domain or sub-domain
MLRSLWDIKNVQKIKLKLEIAVDVHSYFLR

SEQ ID NO: 29227 - protein, 30 aa, artificial
  peptide fold or domain or sub-domain
MYLVNGTIFELSQSMFHYEKTKLLNQINFK

SEQ ID NO: 29228 - protein, 30 aa, artificial
  peptide fold or domain or sub-domain
METKKIREFLIASKIKNNRQNQSISELFIS

SEQ ID NO: 29229 - protein, 30 aa, artificial
  peptide fold or domain or sub-domain
MKILDQTLAKTLPKTNSQKINHLGKLGWIF

SEQ ID NO: 29230 - protein, 30 aa, artificial
  peptide fold or domain or sub-domain
MKSIDVSDSGFACACFDSTSSIYLCYSNGF

SEQ ID NO: 29231 - protein, 25 aa, artificial
  peptide fold or domain or sub-domain
MIKKSILKIKYYVPVLISLTLILSA

SEQ ID NO: 29232 - protein, 30 aa, artificial
  peptide fold or domain or sub-domain
MFYLIMQGANPCQQVGFTVNDPDCRLAKTV

SEQ ID NO: 29233 - protein, 27 aa, artificial
  peptide fold or domain or sub-domain
MIDQCLKSWYIITCRKASHTAERFRNQ

SEQ ID NO: 29234 - protein, 30 aa, artificial
  peptide fold or domain or sub-domain
MSEAVNLLRGARYSQRYAKNQVPYEVIIEK

SEQ ID NO: 29235 - protein, 30 aa, artificial
  peptide fold or domain or sub-domain
MTVMEDPGSEQRNKIQSPMKGEDFSALFGR

SEQ ID NO: 29236 - protein, 30 aa, artificial
  peptide fold or domain or sub-domain
MLTIIIGFIFWTMTLMLGYLIGEREGRKHE

SEQ ID NO: 29237 - protein, 30 aa, artificial
  peptide fold or domain or sub-domain
MPKSCHVPVLCDFFFLVIIKFLALFKTIQS

SEQ ID NO: 29238 - protein, 30 aa, artificial
  peptide fold or domain or sub-domain
MGGYLSVRGCLLPDAIQGIFLEGLFDNPLI

SEQ ID NO: 29239 - protein, 30 aa, artificial
  peptide fold or domain or sub-domain
MKRIKKPFIYKFKTLKEILFYFLKINLLTL

SEQ ID NO: 29240 - protein, 30 aa, artificial
  peptide fold or domain or sub-domain
MKKPLWFMPFLLGISLTTLAQTHVTPFTDN

SEQ ID NO: 29241 - protein, 30 aa, artificial
  peptide fold or domain or sub-domain
MIIRHGEGHMGSNVYKQPYEEFPFLLKIIE

SEQ ID NO: 29242 - protein, 30 aa, artificial
  peptide fold or domain or sub-domain
MLTLSLLVSRLRFERPKTWSDVKSLTSPIQ

SEQ ID NO: 29243 - protein, 30 aa, artificial
  peptide fold or domain or sub-domain
MTSLNRDVKKFNMKQIHTNPPIFDFSYFSA

SEQ ID NO: 29244 - protein, 30 aa, artificial
  peptide fold or domain or sub-domain
MLSLSKTMRITSYGLNALIFRRKQVQWQAE

SEQ ID NO: 29245 - protein, 30 aa, artificial
  peptide fold or domain or sub-domain
MTSMRAGGNLARFLSRFVFNPHSPCRGDGA

SEQ ID NO: 29246 - protein, 30 aa, artificial
  peptide fold or domain or sub-domain
MLIAKGIVGPLRLLTVDRVLEQYSELVEIV

SEQ ID NO: 29247 - protein, 30 aa, artificial
  peptide fold or domain or sub-domain
MVFIEGRDKLEKPTLSIGSKSSMRCKLSEI

SEQ ID NO: 29248 - protein, 30 aa, artificial
  peptide fold or domain or sub-domain
MNFLHFSKDKLALQSPISPNIMNLNNLMLC

SEQ ID NO: 29249 - protein, 29 aa, artificial
  peptide fold or domain or sub-domain
MIIASKAAPKVTKGNQFVSGRLQISYTEK

SEQ ID NO: 29250 - protein, 29 aa, artificial
  peptide fold or domain or sub-domain
MDEKDRAKINKKRPFWSAFLLKLTIPNQE

SEQ ID NO: 29251 - protein, 29 aa, artificial
  peptide fold or domain or sub-domain
MNKEIDNIIRKRLFTENIGSALQFSILMH

SEQ ID NO: 29252 - protein, 29 aa, artificial
  peptide fold or domain or sub-domain
MRLFTVNMTVVLNKSNKMLVSYAFRIGIE

SEQ ID NO: 29253 - protein, 30 aa, artificial
  peptide fold or domain or sub-domain
MKTTNTFKWEEDKPINNTEGFKQSPFFTTI

SEQ ID NO: 29254 - protein, 30 aa, artificial
  peptide fold or domain or sub-domain
MSLDLFKRQTWHFVEMGKSNSCFSKQDHRM

SEQ ID NO: 29255 - protein, 30 aa, artificial
  peptide fold or domain or sub-domain
MSTLNISGYSVVASQKRGLYMSHHANIPKT

SEQ ID NO: 29256 - protein, 30 aa, artificial
  peptide fold or domain or sub-domain
MPLISNMKKFETQLSSVAQQPLPYWLPILM

SEQ ID NO: 29257 - protein, 29 aa, artificial
  peptide fold or domain or sub-domain
MRKEVNDEIPKHIFLTTSKQRLLKLIPIQ

SEQ ID NO: 29258 - protein, 30 aa, artificial
  peptide fold or domain or sub-domain
MPIFNSLFLFNKYNLPAKNEQKLAHLPVNQ

SEQ ID NO: 29259 - protein, 29 aa, artificial
  peptide fold or domain or sub-domain
MATPFKKKNQKKASSDEISFKRLFLALSC

SEQ ID NO: 29260 - protein, 30 aa, artificial
  peptide fold or domain or sub-domain
MQRAYGLAAKGVIATKLTENDHDASLMFSQ

SEQ ID NO: 29261 - protein, 30 aa, artificial
  peptide fold or domain or sub-domain
MIEFQFKSTIDHAWSMVVNGPNNHYVSFQV

SEQ ID NO: 29262 - protein, 29 aa, artificial
  peptide fold or domain or sub-domain
MLRDENPTISADATASAFLYLALLKIEGC

SEQ ID NO: 29263 - protein, 29 aa, artificial
  peptide fold or domain or sub-domain
MNALFWHIFIDSHVIYFTAFTALSYLFHK

SEQ ID NO: 29264 - protein, 30 aa, artificial
  peptide fold or domain or sub-domain
MCKIHQWLAKNTNLRTAKPERRNASGFIFI

SEQ ID NO: 29265 - protein, 29 aa, artificial
  peptide fold or domain or sub-domain
MNEKVPWFLKFFVIVFSQCDVMRQIPCTA

SEQ ID NO: 29266 - protein, 29 aa, artificial
  peptide fold or domain or sub-domain
MVGGHKANTQRGGKELTWTVLVKPHKYNN

SEQ ID NO: 29267 - protein, 30 aa, artificial
  peptide fold or domain or sub-domain
MFVVLSAYGTDISQNKKGALAPFSNQMRGD

SEQ ID NO: 29268 - protein, 29 aa, artificial
  peptide fold or domain or sub-domain
MAHLLTGKETDRKLFIGMSESFSSLKLPM

SEQ ID NO: 29269 - protein, 29 aa, artificial
  peptide fold or domain or sub-domain
MLILTNIIHYRCEKVVDNDFLTFVSVFNV

SEQ ID NO: 29270 - protein, 29 aa, artificial
  peptide fold or domain or sub-domain
MPRYSYASIIGLASIVFVELIALLSFVFL

SEQ ID NO: 29271 - protein, 29 aa, artificial
  peptide fold or domain or sub-domain
MLLNSFRHDNFRYFKTLIVRYFKIFREST

SEQ ID NO: 29272 - protein, 29 aa, artificial
  peptide fold or domain or sub-domain
MVLVYGHLQPTIEHSYLLLIDETIRFFGA

SEQ ID NO: 29273 - protein, 30 aa, artificial
  peptide fold or domain or sub-domain
MVIVCAGETKNAFKNEALIVKSGIIKAIFY

SEQ ID NO: 29274 - protein, 29 aa, artificial
  peptide fold or domain or sub-domain
MGRFIFGFSKYKIGGIVASYLLDVRYIDE

SEQ ID NO: 29275 - protein, 29 aa, artificial
  peptide fold or domain or sub-domain
MKNRVLYNSVFTLKHSGTHLLTHDNLFFM

SEQ ID NO: 29276 - protein, 30 aa, artificial
  peptide fold or domain or sub-domain
MPAFGLAFFIRLCAHLFLLLKAFLCTNKCQ

SEQ ID NO: 29277 - protein, 30 aa, artificial
  peptide fold or domain or sub-domain
MLLSHSIGIICFIALPNEISSYGFFLSLRR

SEQ ID NO: 29278 - protein, 29 aa, artificial
  peptide fold or domain or sub-domain
MNPEFEVRCKEAEANASASFINLESSFAY

SEQ ID NO: 29279 - protein, 29 aa, artificial
  peptide fold or domain or sub-domain
MALFWGDLSLYSERNSKRKQSDISIQSKK

SEQ ID NO: 29280 - protein, 29 aa, artificial
  peptide fold or domain or sub-domain
MNVFQRCASARKNSDNKKRCHWQRFFVLG

SEQ ID NO: 29281 - protein, 30 aa, artificial
  peptide fold or domain or sub-domain
MCLLHFHTLHSELVGKVIMAAKRQKNVNKE

SEQ ID NO: 29282 - protein, 30 aa, artificial
  peptide fold or domain or sub-domain
MWRLPLQAIQHHVVCDAVERHGAMLKLEQN

SEQ ID NO: 29283 - protein, 29 aa, artificial
  peptide fold or domain or sub-domain
MTLNIKANTVKAQAYSANLNWTLSDLPTN

SEQ ID NO: 29284 - protein, 30 aa, artificial
  peptide fold or domain or sub-domain
MVEILVNTAISVYIVALYTQWLSTRDNLKA

SEQ ID NO: 29285 - protein, 30 aa, artificial
  peptide fold or domain or sub-domain
MREKVRFTQAFKLFWTNYFNFKGRSRRSEY

SEQ ID NO: 29286 - protein, 30 aa, artificial
  peptide fold or domain or sub-domain
MTLAIKNCSVTKCLGFGDFVNDDSDSYFDA

SEQ ID NO: 29287 - protein, 30 aa, artificial
  peptide fold or domain or sub-domain
MYDKEIDKMIANSSEKRMSFNENQSHRPLL

SEQ ID NO: 29288 - protein, 30 aa, artificial
  peptide fold or domain or sub-domain
MFNKCEFLEEGVKDYDIKPSSTCVKPRTIN

SEQ ID NO: 29289 - protein, 30 aa, artificial
  peptide fold or domain or sub-domain
MARNDDDIKKIKGTLGQSPEVYGERKLPYT

SEQ ID NO: 29290 - protein, 30 aa, artificial
  peptide fold or domain or sub-domain
MSVFVPVTNIFMFIMSPIFNVNLLHFKVYI

SEQ ID NO: 29291 - protein, 30 aa, artificial
  peptide fold or domain or sub-domain
MVNYIIGSYMLYREQNNNEALRKFDITLAM

SEQ ID NO: 29292 - protein, 30 aa, artificial
  peptide fold or domain or sub-domain
MQSTVTNIFEGIFKEGRDELSLVIGNTMCE

SEQ ID NO: 29293 - protein, 26 aa, artificial
  peptide fold or domain or sub-domain
MNAICLLCRRKKGKTSFPRHVRLTHT

SEQ ID NO: 29294 - protein, 28 aa, artificial
  peptide fold or domain or sub-domain
MIYPAKTLGEPAATAEPQSTLSPIRASA

SEQ ID NO: 29295 - protein, 30 aa, artificial
  peptide fold or domain or sub-domain
MKKNLKRFYALVLGFIIGCLFVSILIFIGY

SEQ ID NO: 29296 - protein, 30 aa, artificial
  peptide fold or domain or sub-domain
MQKRKNQTGSFFFAFQLLTTICKKLQVVVS

SEQ ID NO: 29297 - protein, 30 aa, artificial
  peptide fold or domain or sub-domain
MSLFLEIFNQEWTPQVAIGSVQRFCFTLGA

SEQ ID NO: 29298 - protein, 30 aa, artificial
  peptide fold or domain or sub-domain
MENLMPLFIYTLRQRKFLKPIASQNSAKYR

SEQ ID NO: 29299 - protein, 30 aa, artificial
  peptide fold or domain or sub-domain
MMFNQAAKLILVIITVVIIKSQRGRRMANW

SEQ ID NO: 29300 - protein, 30 aa, artificial
  peptide fold or domain or sub-domain
MGLLFTGFSVVAVNQHVALVIPPTLLGGGV

SEQ ID NO: 29301 - protein, 30 aa, artificial
  peptide fold or domain or sub-domain
MSHFTNLDKDKSSVLRAFFAKAEQETRHFG

SEQ ID NO: 29302 - protein, 30 aa, artificial
  peptide fold or domain or sub-domain
MCHNSVLSIQVGLKLSVLPSVAIEEKLAQG

SEQ ID NO: 29303 - protein, 30 aa, artificial
  peptide fold or domain or sub-domain
MFSNTGFFVNQALHLAINKLIKQSSHSFAL

SEQ ID NO: 29304 - protein, 30 aa, artificial
  peptide fold or domain or sub-domain
MDMRCALDSGQADPVLKLRSLYTSVKMVLG

SEQ ID NO: 29305 - protein, 30 aa, artificial
  peptide fold or domain or sub-domain
MCKRTLLALDKKEMSLNLTNRWVLSSHDQE

SEQ ID NO: 29306 - protein, 30 aa, artificial
  peptide fold or domain or sub-domain
MTNLNIRHPVGKNSLERLAVMTFALFTIGR

SEQ ID NO: 29307 - protein, 30 aa, artificial
  peptide fold or domain or sub-domain
MVTVLMSLIAANKRYRSEKTKHSNAGIFSR

SEQ ID NO: 29308 - protein, 30 aa, artificial
  peptide fold or domain or sub-domain
MDVTAKIMWISVCLSRLNFVNMPAHSVISG

SEQ ID NO: 29309 - protein, 30 aa, artificial
  peptide fold or domain or sub-domain
MAPKGLVSTRFMAFDRAALCLQAFALSKAR

SEQ ID NO: 29310 - protein, 30 aa, artificial
  peptide fold or domain or sub-domain
MFYYFHEGVVGWHSVKLKIKKYPLLIFVGY

SEQ ID NO: 29311 - protein, 30 aa, artificial
  peptide fold or domain or sub-domain
MAFSQYLTQEWALVYIAQYQLHLGILNLKS

SEQ ID NO: 29312 - protein, 30 aa, artificial
  peptide fold or domain or sub-domain
MDSKTIKAAMKAAFIFVTTKLTFITQGFTQ

SEQ ID NO: 29313 - protein, 30 aa, artificial
  peptide fold or domain or sub-domain
MASYFDEPRFAVTQELTELTNRLFKLFHRF

SEQ ID NO: 29314 - protein, 30 aa, artificial
  peptide fold or domain or sub-domain
MKELAQFILLNVVPVTINGPYLNHFNSGKL

SEQ ID NO: 29315 - protein, 30 aa, artificial
  peptide fold or domain or sub-domain
MARRKPILGGSTEKSLFPMATAATMLACKL

SEQ ID NO: 29316 - protein, 30 aa, artificial
  peptide fold or domain or sub-domain
MFLLFREKSVLAREKHKPLYKRTAQNNKWV

SEQ ID NO: 29317 - protein, 30 aa, artificial
  peptide fold or domain or sub-domain
MLYRVADKTCDPMALDEFKKPAFWLVFLWM

SEQ ID NO: 29318 - protein, 30 aa, artificial
  peptide fold or domain or sub-domain
MLKRSNRIRYRTALPLGAIVWGELSVFFAR

SEQ ID NO: 29319 - protein, 30 aa, artificial
  peptide fold or domain or sub-domain
MKNSGCSLSDTVVHKGLKQLLKTELILNER

SEQ ID NO: 29320 - protein, 30 aa, artificial
  peptide fold or domain or sub-domain
MYSAPPFFRIAAVIHDIDFTNLFVQPIDKI

SEQ ID NO: 29321 - protein, 30 aa, artificial
  peptide fold or domain or sub-domain
MNQGGVGHGRIKKHHPVFAFSQFLSMSMST

SEQ ID NO: 29322 - protein, 30 aa, artificial
  peptide fold or domain or sub-domain
MLYKVSKVDIVDELFKSKTLYTQICSKYKL

SEQ ID NO: 29323 - protein, 30 aa, artificial
  peptide fold or domain or sub-domain
MWRLTTPRRSKPTKLKTHVYSLKAERAAPL

SEQ ID NO: 29324 - protein, 30 aa, artificial
  peptide fold or domain or sub-domain
MSQFVAFTGQKKAANAALVRYYLVPFSQLI

SEQ ID NO: 29325 - protein, 30 aa, artificial
  peptide fold or domain or sub-domain
MVIFKPRLVMFHKPSDANCGTLSAQKMCQG

SEQ ID NO: 29326 - protein, 28 aa, artificial
  peptide fold or domain or sub-domain
MDMEGVLTLMISFGTLIAFIMSEINQKK

SEQ ID NO: 29327 - protein, 30 aa, artificial
  peptide fold or domain or sub-domain
MKANENNILWLKIAGYTPDEIVVSSGTFPI

SEQ ID NO: 29328 - protein, 30 aa, artificial
  peptide fold or domain or sub-domain
MLKKAFLEHDPGGMNEYWQDYNFIRMCLYC

SEQ ID NO: 29329 - protein, 30 aa, artificial
  peptide fold or domain or sub-domain
MADFSFSVALNRISLKHNPESCRLFRPDDA

SEQ ID NO: 29330 - protein, 30 aa, artificial
  peptide fold or domain or sub-domain
MDARRCDDERNSARKLFASFSELLLKEVRA

SEQ ID NO: 29331 - protein, 30 aa, artificial
  peptide fold or domain or sub-domain
MFGLTANEIEPAHANGRERMIAPKLQQLRP

SEQ ID NO: 29332 - protein, 30 aa, artificial
  peptide fold or domain or sub-domain
MRGSVTAGLIFSLDLATMGSCMMRVKLKGV

SEQ ID NO: 29333 - protein, 30 aa, artificial
  peptide fold or domain or sub-domain
MQNISRMSESILNKNLWAKLKYALARLRKM

SEQ ID NO: 29334 - protein, 30 aa, artificial
  peptide fold or domain or sub-domain
MELCILPRQAALIAINCGLYAAFRMASANS

SEQ ID NO: 29335 - protein, 30 aa, artificial
  peptide fold or domain or sub-domain
MHLFYVLQNALSMRLFANSKNGYFSKKFVF

SEQ ID NO: 29336 - protein, 30 aa, artificial
  peptide fold or domain or sub-domain
MCLRSFDRNLKQTHSKSSNKKNNPAFILDR

SEQ ID NO: 29337 - protein, 30 aa, artificial
  peptide fold or domain or sub-domain
MTISNAQKRNRMKALPILKGNKFIVYYLTL

SEQ ID NO: 29338 - protein, 30 aa, artificial
  peptide fold or domain or sub-domain
MNSRFISMKKQGISEMFTIPMFCRFAYLSA

SEQ ID NO: 29339 - protein, 30 aa, artificial
  peptide fold or domain or sub-domain
MVLSKQLYINKPAQVTAKFHTFTFGELVTV

SEQ ID NO: 29340 - protein, 30 aa, artificial
  peptide fold or domain or sub-domain
MVASDRKAYFRSVSRELQAAGLPVDMNKAL

SEQ ID NO: 29341 - protein, 30 aa, artificial
  peptide fold or domain or sub-domain
MVMDGVNGLFSRVMRVFCGKTLPDNNNNHL

SEQ ID NO: 29342 - protein, 30 aa, artificial
  peptide fold or domain or sub-domain
MVNLNTSFRLYGLFFEKKCMIPSIITNPNR

SEQ ID NO: 29343 - protein, 27 aa, artificial
  peptide fold or domain or sub-domain
MLINEARLYRNVFSVMLRNDLKRYIDF

SEQ ID NO: 29344 - protein, 28 aa, artificial
  peptide fold or domain or sub-domain
MITGRLCSNHRGSMEELRDENQTITQEP

SEQ ID NO: 29345 - protein, 29 aa, artificial
  peptide fold or domain or sub-domain
MKKFIILLFILVQGLIFSATKTLSDIIAL

SEQ ID NO: 29346 - protein, 25 aa, artificial
  peptide fold or domain or sub-domain
MDEEALEMGANLYAQFAIDFLNSKK

SEQ ID NO: 29347 - protein, 30 aa, artificial
  peptide fold or domain or sub-domain
MWAAPAFGERFSDFDATNTGAVCKSSTQNI

SEQ ID NO: 29348 - protein, 25 aa, artificial
  peptide fold or domain or sub-domain
MNFSYMESYFEHEGLRGYVAYYEYC

SEQ ID NO: 29349 - protein, 25 aa, artificial
  peptide fold or domain or sub-domain
MICNTHREPFYINIIIIVNHNSQVL

SEQ ID NO: 29350 - protein, 25 aa, artificial
  peptide fold or domain or sub-domain
MTQDEGQERQEAKTEDCQEDKRPET

SEQ ID NO: 29351 - protein, 29 aa, artificial
  peptide fold or domain or sub-domain
MFDRIYLGDRAIKKLNLIYGVNKLEFRLI

SEQ ID NO: 29352 - protein, 27 aa, artificial
  peptide fold or domain or sub-domain
MFDDKKLAQEDKKSPCANALSQVTNHI

SEQ ID NO: 29353 - protein, 26 aa, artificial
  peptide fold or domain or sub-domain
MLSFNVYIFLLKSKNYLNYPLNITYS

SEQ ID NO: 29354 - protein, 29 aa, artificial
  peptide fold or domain or sub-domain
MYSLSTNIGKKYNLKVWFTKNKTVFYANS

SEQ ID NO: 29355 - protein, 17 aa, artificial
  peptide fold or domain or sub-domain
METVSPFPGGKYGLLKV

SEQ ID NO: 29356 - protein, 24 aa, artificial
  peptide fold or domain or sub-domain
MSVFPSHRDIVPDKAIIIQKALQS

SEQ ID NO: 29357 - protein, 26 aa, artificial
  peptide fold or domain or sub-domain
MKWLSKSSVQGDAPRIALIDIVDSLT

SEQ ID NO: 29358 - protein, 20 aa, artificial
  peptide fold or domain or sub-domain
MPVNSYPYGVFGFANKKWLL

SEQ ID NO: 29359 - protein, 24 aa, artificial
  peptide fold or domain or sub-domain
MYVATKSWLAQNEEHLSKEVINLV

SEQ ID NO: 29360 - protein, 18 aa, artificial
  peptide fold or domain or sub-domain
MALLQFIGMKKYNLSCMK

SEQ ID NO: 29361 - protein, 29 aa, artificial
  peptide fold or domain or sub-domain
MTWLYAVSGAVTVALLIYLFAALLWPERF

SEQ ID NO: 29362 - protein, 28 aa, artificial
  peptide fold or domain or sub-domain
MVPESALPYHFRDPMPDVPHRTRVLERA

SEQ ID NO: 29363 - protein, 28 aa, artificial
  peptide fold or domain or sub-domain
MPDWDFNNPESMKAWDLASGSYAEQVSG

SEQ ID NO: 29364 - protein, 30 aa, artificial
  peptide fold or domain or sub-domain
MKNHFLAELANKYDVQYLLQSRVLNTKRKR

SEQ ID NO: 29365 - protein, 30 aa, artificial
  peptide fold or domain or sub-domain
VAYEAPFRCRTVASGSGPRSDRYHNLRAQP

SEQ ID NO: 29366 - protein, 28 aa, artificial
  peptide fold or domain or sub-domain
MLKLTFKVNGDGKVDNEDLKIIAQSTTH

SEQ ID NO: 29367 - protein, 30 aa, artificial
  peptide fold or domain or sub-domain
MAAKLWEEGKMVYASSASMTKRLKLAMSKV

SEQ ID NO: 29368 - protein, 30 aa, artificial
  peptide fold or domain or sub-domain
MQIFYIKTKIFLSFFLFLLIFSQCFYKIEE

SEQ ID NO: 29369 - protein, 30 aa, artificial
  peptide fold or domain or sub-domain
MSTSSRVLVLKKFHGIMDGNRNVAVFFVGQ

SEQ ID NO: 29370 - protein, 30 aa, artificial
  peptide fold or domain or sub-domain
MSRWDGHSDKGEAPAGKPPMHGFGLNGENK

SEQ ID NO: 29371 - protein, 30 aa, artificial
  peptide fold or domain or sub-domain
MLQKYTQMISVTKCIITKNKKTQENVDAYN

SEQ ID NO: 29372 - protein, 30 aa, artificial
  peptide fold or domain or sub-domain
MSRKKYENDEKSQKKLKIGRKSDVFYGIID

SEQ ID NO: 29373 - protein, 30 aa, artificial
  peptide fold or domain or sub-domain
MIDVTIGQKSKTGAFNASYSICFSGENFSF

SEQ ID NO: 29374 - protein, 27 aa, artificial
  peptide fold or domain or sub-domain
MTETGYNRYTEIIKPIILREYTNYKSR

SEQ ID NO: 29375 - protein, 30 aa, artificial
  peptide fold or domain or sub-domain
MPLRMPALIWPRDVAKRGIKTKDPRQSMLS

SEQ ID NO: 29376 - protein, 30 aa, artificial
  peptide fold or domain or sub-domain
MELQLSKVREPERIGAPNVIAVSFVTRPHK

SEQ ID NO: 29377 - protein, 30 aa, artificial
  peptide fold or domain or sub-domain
MRGWAPVGERLYAEVPHGHWQTMTPGGTAP

SEQ ID NO: 29378 - protein, 30 aa, artificial
  peptide fold or domain or sub-domain
MKKFGFGMVDVETPFTMHGDMSDAKATHQG

SEQ ID NO: 29379 - protein, 30 aa, artificial
  peptide fold or domain or sub-domain
MFLRARPGEHFREETHESGSWLVLHASQYR

SEQ ID NO: 29380 - protein, 30 aa, artificial
  peptide fold or domain or sub-domain
MRGKTQEDRDLSRCSIPWPRASATRLFACA

SEQ ID NO: 29381 - protein, 22 aa, artificial
  peptide fold or domain or sub-domain
ACGAPVSPGAIPAQREETGSHG

SEQ ID NO: 29382 - protein, 30 aa, artificial
  peptide fold or domain or sub-domain
MSAVTVADIPESNGKGKAIIGDKEKHRYQA

SEQ ID NO: 29383 - protein, 30 aa, artificial
  peptide fold or domain or sub-domain
MQLFCHAVKYPHDKIMQNWDKTGARLHKPV

SEQ ID NO: 29384 - protein, 29 aa, artificial
  peptide fold or domain or sub-domain
MGVFDILPSGLVCLFEYDFLWSGRHAAKA

SEQ ID NO: 29385 - protein, 24 aa, artificial
  peptide fold or domain or sub-domain
PVLMNLGLTQERWPDVVFHETREH

SEQ ID NO: 29386 - protein, 30 aa, artificial
  peptide fold or domain or sub-domain
MLGKIKTRAWIFVKKIIFQIRHKPTDGKIL

SEQ ID NO: 29387 - protein, 29 aa, artificial
  peptide fold or domain or sub-domain
MLATHSNPETAYSDTHHCRFSLLLRFRRL

SEQ ID NO: 29388 - protein, 30 aa, artificial
  peptide fold or domain or sub-domain
MAVKPLGYIRGIGRQRNALKTQFEPLKAID

SEQ ID NO: 29389 - protein, 29 aa, artificial
  peptide fold or domain or sub-domain
MKQCACRDLCLMPASNSAGMRAHKTLNAE

SEQ ID NO: 29390 - protein, 27 aa, artificial
  peptide fold or domain or sub-domain
MGKISRLMEHGPIFKQNLNQQLKKDKT

SEQ ID NO: 29391 - protein, 27 aa, artificial
  peptide fold or domain or sub-domain
MRHLKSACRQISKCKSRLKAKNVLRMQ

SEQ ID NO: 29392 - protein, 30 aa, artificial
  peptide fold or domain or sub-domain
MPSENGRRIIGKTYRASFAVAKLHLKTPAA

SEQ ID NO: 29393 - protein, 26 aa, artificial
  peptide fold or domain or sub-domain
MKVKAYISIFYTPTEKNTMNCLLDLY

SEQ ID NO: 29394 - protein, 28 aa, artificial
  peptide fold or domain or sub-domain
MSNDENLLFSQPHLTKVNIMQVLTLNEI

SEQ ID NO: 29395 - protein, 30 aa, artificial
  peptide fold or domain or sub-domain
MKKEFDSDNYLARMHSLFGKKAEAKRSLTI

SEQ ID NO: 29396 - protein, 29 aa, artificial
  peptide fold or domain or sub-domain
MFFVLKGWPDYFEKVFGKQWCRYSCWHAS

SEQ ID NO: 29397 - protein, 18 aa, artificial
  peptide fold or domain or sub-domain
MKRNAYHKKDRGVPATAT

SEQ ID NO: 29398 - protein, 30 aa, artificial
  peptide fold or domain or sub-domain
MQSLILVKQTLENKMMPLAHQGLKEVRWVI

SEQ ID NO: 29399 - protein, 22 aa, artificial
  peptide fold or domain or sub-domain
MEIQQRLVAYCLTITNHLRDPR

SEQ ID NO: 29400 - protein, 25 aa, artificial
  peptide fold or domain or sub-domain
MNLSMIVQKQNIFIDWSTIYLNLLS

SEQ ID NO: 29401 - protein, 17 aa, artificial
  peptide fold or domain or sub-domain
MSEKGRALNDNKKQTNR

SEQ ID NO: 29402 - protein, 30 aa, artificial
  peptide fold or domain or sub-domain
MDSESHDQGNMFISIGATVTIAAFSMMADK

SEQ ID NO: 29403 - protein, 15 aa, artificial
  peptide fold or domain or sub-domain
MNMADFQTWVLSYPI

SEQ ID NO: 29404 - protein, 24 aa, artificial
  peptide fold or domain or sub-domain
MNSAAIKKQTEKYGASRRGLRREP

SEQ ID NO: 29405 - protein, 22 aa, artificial
  peptide fold or domain or sub-domain
MKHRVLLFSIEKGKGPLINTFN

SEQ ID NO: 29406 - protein, 17 aa, artificial
  peptide fold or domain or sub-domain
MKEIPTKMKMIEKDEHP

SEQ ID NO: 29407 - protein, 28 aa, artificial
  peptide fold or domain or sub-domain
MHKRLTIEKEEKLNRVHISQQPEKKHIF

SEQ ID NO: 29408 - protein, 22 aa, artificial
  peptide fold or domain or sub-domain
MTFSPAEKEVTQTKTSIIHIAS

SEQ ID NO: 29409 - protein, 29 aa, artificial
  peptide fold or domain or sub-domain
MTRALLIMFFVLIGMVLFFATQLHDKAIF

SEQ ID NO: 29410 - protein, 29 aa, artificial
  peptide fold or domain or sub-domain
MPRKFQQLIIYIMIITIVVGSLLMGVSIF

SEQ ID NO: 29411 - protein, 29 aa, artificial
  peptide fold or domain or sub-domain
MNTILILGVCLAFLVSIFTAGYEDNPHKN

SEQ ID NO: 29412 - protein, 14 aa, artificial
  peptide fold or domain or sub-domain
MKDTVLANPAVIYE

SEQ ID NO: 29413 - protein, 24 aa, artificial
  peptide fold or domain or sub-domain
MIHASLLILIFKNARDATRADLIF

SEQ ID NO: 29414 - protein, 26 aa, artificial
  peptide fold or domain or sub-domain
MEWNVLVGVIIIFAVAIGLFSMKKKK

SEQ ID NO: 29415 - protein, 23 aa, artificial
  peptide fold or domain or sub-domain
MEGVFHVIEASFVSSSMVLIKLN

SEQ ID NO: 29416 - protein, 27 aa, artificial
  peptide fold or domain or sub-domain
MTVFEALMFAVAFATLIIAVLSFHEKK

SEQ ID NO: 29417 - protein, 30 aa, artificial
  peptide fold or domain or sub-domain
MMQNRCMQQRLLGDTSQLVAIFTQPYRVCA

SEQ ID NO: 29418 - protein, 30 aa, artificial
  peptide fold or domain or sub-domain
MSLIDLFKTDDIVQASTPFSEKWVTTAKLL

SEQ ID NO: 29419 - protein, 30 aa, artificial
  peptide fold or domain or sub-domain
MKAIKNGAKSRHFYCLGSFLFRKERADVYN

SEQ ID NO: 29420 - protein, 30 aa, artificial
  peptide fold or domain or sub-domain
MSSSTLKVSHSGYLHRGIHTHLVLTPCANT

SEQ ID NO: 29421 - protein, 30 aa, artificial
  peptide fold or domain or sub-domain
MSDHAVMGLILEKRVCVTDCNDESEVNSHE

SEQ ID NO: 29422 - protein, 30 aa, artificial
  peptide fold or domain or sub-domain
MSGLFIGFFHLSLLFRYFLNAVISAQSNHG

SEQ ID NO: 29423 - protein, 30 aa, artificial
  peptide fold or domain or sub-domain
MVAPHNFQKFILFYEHELLRLNVTAYPYPF

SEQ ID NO: 29424 - protein, 30 aa, artificial
  peptide fold or domain or sub-domain
MRHTAHLFTFSVNNRVKKLGGCVKKGIYQQ

SEQ ID NO: 29425 - protein, 30 aa, artificial
  peptide fold or domain or sub-domain
MAKQFANAQILVFSGIKKMRKMRALAGTKL

SEQ ID NO: 29426 - protein, 26 aa, artificial
  peptide fold or domain or sub-domain
MGDYRSSSHVYWRCKYHIVWTPRETA

SEQ ID NO: 29427 - protein, 30 aa, artificial
  peptide fold or domain or sub-domain
MLQCCRTVFGFSVVDHDVNHNALIPDGAAF

SEQ ID NO: 29428 - protein, 30 aa, artificial
  peptide fold or domain or sub-domain
MTAMTVGRWEIAFKVGQLHVEYFYQVSGYL

SEQ ID NO: 29429 - protein, 30 aa, artificial
  peptide fold or domain or sub-domain
MVVSGGIDALLSAPAVGIDLMKHNEGTFMA

SEQ ID NO: 29430 - protein, 30 aa, artificial
  peptide fold or domain or sub-domain
MVVLSVVFGSGALPPTSQRTNMAAHQRVVS

SEQ ID NO: 29431 - protein, 30 aa, artificial
  peptide fold or domain or sub-domain
MLVLQLIGKTKNISQSKIKTLIIIPIAAPK

SEQ ID NO: 29432 - protein, 30 aa, artificial
  peptide fold or domain or sub-domain
MRKGKIGICLLVIEKSILVGLLMFNKIVIR

SEQ ID NO: 29433 - protein, 29 aa, artificial
  peptide fold or domain or sub-domain
MCRELLAKARLHPIESETDDTVLPTELTA

SEQ ID NO: 29434 - protein, 19 aa, artificial
  peptide fold or domain or sub-domain
MLMSHGGEVEEGACQCSFI

SEQ ID NO: 29435 - protein, 27 aa, artificial
  peptide fold or domain or sub-domain
MRKEFHNVLSSGQLLADKRPARDYNRK

SEQ ID NO: 29436 - protein, 30 aa, artificial
  peptide fold or domain or sub-domain
MVLFASHAKRKITAFSDIDLLVVYDDPTQR

SEQ ID NO: 29437 - protein, 30 aa, artificial
  peptide fold or domain or sub-domain
MNENYIGGKHFEKNRKTGALAPVPGRGGGT

SEQ ID NO: 29438 - protein, 30 aa, artificial
  peptide fold or domain or sub-domain
MEKTEYKRNALGAGWNSRPAVKAREPSQEG

SEQ ID NO: 29439 - protein, 21 aa, artificial
  peptide fold or domain or sub-domain
MVENSGIEPLTSCVQSRCSPS

SEQ ID NO: 29440 - protein, 30 aa, artificial
  peptide fold or domain or sub-domain
MEGNAVVIDTGARGVRLFIKCFYKNNRIFH

SEQ ID NO: 29441 - protein, 29 aa, artificial
  peptide fold or domain or sub-domain
LDNSFVRPSPFLNSVLAQPRESLAPGTVP

SEQ ID NO: 29442 - protein, 25 aa, artificial
  peptide fold or domain or sub-domain
MLLSGADCFFLVNRAQKSKTESCQD

SEQ ID NO: 29443 - protein, 26 aa, artificial
  peptide fold or domain or sub-domain
DHGKMETLSTRATPSTQLCRACSRNG

SEQ ID NO: 29444 - protein, 22 aa, artificial
  peptide fold or domain or sub-domain
MPLCLSPARLDGPHLSCLSSPR

SEQ ID NO: 29445 - protein, 22 aa, artificial
  peptide fold or domain or sub-domain
PRASKGAQTGTLVEEMVAVASG

SEQ ID NO: 29446 - protein, 28 aa, artificial
  peptide fold or domain or sub-domain
NSTFSELFKKEHPDRFIECYIAEQNMVG

SEQ ID NO: 29447 - protein, 13 aa, artificial
  peptide fold or domain or sub-domain
TWPLPVLQPQTCL

SEQ ID NO: 29448 - protein, 28 aa, artificial
  peptide fold or domain or sub-domain
WRSNDRRNSNLIEETKLRIISFANHRSP

SEQ ID NO: 29449 - protein, 24 aa, artificial
  peptide fold or domain or sub-domain
RAHDTTPMVVHCSAGVGRTGVFIA

SEQ ID NO: 29450 - protein, 25 aa, artificial
  peptide fold or domain or sub-domain
KSTWSTLEASTTPMAGQFLDGKEIK

SEQ ID NO: 29451 - protein, 24 aa, artificial
  peptide fold or domain or sub-domain
QLRSGPLAGISLGMVGCGRAWNEE

SEQ ID NO: 29452 - protein, 25 aa, artificial
  peptide fold or domain or sub-domain
MWLYWRSLPGCHWRQNGGAAGLENG

SEQ ID NO: 29453 - protein, 28 aa, artificial
  peptide fold or domain or sub-domain
MFDCMDVLSVSPGQILDFYTASPSSCML

SEQ ID NO: 29454 - protein, 30 aa, artificial
  peptide fold or domain or sub-domain
GRRSEMPWTLQKRFCAATQKPGCVKIGCTG

SEQ ID NO: 29455 - protein, 17 aa, artificial
  peptide fold or domain or sub-domain
GSHTLQWMYGCDLGSDW

SEQ ID NO: 29456 - protein, 27 aa, artificial
  peptide fold or domain or sub-domain
MNREEWTRETAHLCLSFFCWELPISLK

SEQ ID NO: 29457 - protein, 22 aa, artificial
  peptide fold or domain or sub-domain
LWKVQPLVEKSHHQASLSCEVS

SEQ ID NO: 29458 - protein, 24 aa, artificial
  peptide fold or domain or sub-domain
ADVETEEPNQAEVIIYFSGFLITS

SEQ ID NO: 29459 - protein, 30 aa, artificial
  peptide fold or domain or sub-domain
MVKVGVNGFGRIGRLVTRAAICSGKVEIVA

SEQ ID NO: 29460 - protein, 29 aa, artificial
  peptide fold or domain or sub-domain
LANSHHVAINGKIICNPRAMIMVRLWIRS

SEQ ID NO: 29461 - protein, 14 aa, artificial
  peptide fold or domain or sub-domain
LQSTRTVQQEENEH

SEQ ID NO: 29462 - protein, 13 aa, artificial
  peptide fold or domain or sub-domain
MPTPSWQFCLLFS

SEQ ID NO: 29463 - protein, 18 aa, artificial
  peptide fold or domain or sub-domain
MLQLPDQLWRPKQAAWRS

SEQ ID NO: 29464 - protein, 16 aa, artificial
  peptide fold or domain or sub-domain
MDEKLFTKELDQWIEQ

SEQ ID NO: 29465 - protein, 29 aa, artificial
  peptide fold or domain or sub-domain
MIYENLQNSRIEEKTQEPGKDSQLRRDLG

SEQ ID NO: 29466 - protein, 26 aa, artificial
  peptide fold or domain or sub-domain
MGLRIHFVVDPHGWCCMGLIVFVWLY

SEQ ID NO: 29467 - protein, 13 aa, artificial
  peptide fold or domain or sub-domain
MVQTELDCLLPMD

SEQ ID NO: 29468 - protein, 12 aa, artificial
  peptide fold or domain or sub-domain
WTSSGLGKTYLA

SEQ ID NO: 29469 - protein, 25 aa, artificial
  peptide fold or domain or sub-domain
GDRDYEMTDQNHIKPERSNSISFTA

SEQ ID NO: 29470 - protein, 27 aa, artificial
  peptide fold or domain or sub-domain
WGLQCAHMEWCKRCWRNSEVTEPSNRN

SEQ ID NO: 29471 - protein, 18 aa, artificial
  peptide fold or domain or sub-domain
MSSGKQDSPWEDRIPPGR

SEQ ID NO: 29472 - protein, 29 aa, artificial
  peptide fold or domain or sub-domain
RSLPTRVSANNDVVIRVTYTALRSRGSPV

SEQ ID NO: 29473 - protein, 29 aa, artificial
  peptide fold or domain or sub-domain
PERVQDGGARMPPARLSASWCTIRTELAR

SEQ ID NO: 29474 - protein, 17 aa, artificial
  peptide fold or domain or sub-domain
FKDKLEEFFKKDSNLWN

SEQ ID NO: 29475 - protein, 17 aa, artificial
  peptide fold or domain or sub-domain
FKDKLEEFFKKGILDTY

SEQ ID NO: 29476 - protein, 25 aa, artificial
  peptide fold or domain or sub-domain
PSFTQTPSSAKTSLWEWRWCFTAAP

SEQ ID NO: 29477 - protein, 28 aa, artificial
  peptide fold or domain or sub-domain
MCPPPISLTNTPHPCLFMPICFCKQEDC

SEQ ID NO: 29478 - protein, 22 aa, artificial
  peptide fold or domain or sub-domain
EGDPPACYGTVVGFRELGTLTV

SEQ ID NO: 29479 - protein, 16 aa, artificial
  peptide fold or domain or sub-domain
MSSISDTVKRAREARE

SEQ ID NO: 29480 - protein, 13 aa, artificial
  peptide fold or domain or sub-domain
MPLFKLTEIDDAM

SEQ ID NO: 29481 - protein, 18 aa, artificial
  peptide fold or domain or sub-domain
MGWVGATRCGQRASETRP

SEQ ID NO: 29482 - protein, 29 aa, artificial
  peptide fold or domain or sub-domain
MNCRGAGIIKPLTSPFQKLHKTAYIRGRL

SEQ ID NO: 29483 - protein, 18 aa, artificial
  peptide fold or domain or sub-domain
MCSSHVQSCPSAIMTKDY

SEQ ID NO: 29484 - protein, 20 aa, artificial
  peptide fold or domain or sub-domain
MVVYPKYCLDRGTLMFTPDP

SEQ ID NO: 29485 - protein, 26 aa, artificial
  peptide fold or domain or sub-domain
RSHLPLNADSEYVTLSDHHFLGTASS

SEQ ID NO: 29486 - protein, 30 aa, artificial
  peptide fold or domain or sub-domain
AWNQRWGWDILFLMLVILFNSEIFKVPCVS

SEQ ID NO: 29487 - protein, 24 aa, artificial
  peptide fold or domain or sub-domain
ATTVIGSTLYSAPAILHFNHPFVF

SEQ ID NO: 29488 - protein, 24 aa, artificial
  peptide fold or domain or sub-domain
GMSLILGVRIGDGNPSSAISHAVL

SEQ ID NO: 29489 - protein, 25 aa, artificial
  peptide fold or domain or sub-domain
MAPTGWSRKASSRVTGTRLWIALMT

SEQ ID NO: 29490 - protein, 28 aa, artificial
  peptide fold or domain or sub-domain
KSKKVKDPRNRGPATRSCQVSHRSHKTE

SEQ ID NO: 29491 - protein, 26 aa, artificial
  peptide fold or domain or sub-domain
MNTQVIEVMVSSPRGIVSISTGDRPD

SEQ ID NO: 29492 - protein, 30 aa, artificial
  peptide fold or domain or sub-domain
SPSMEALTLHSPTQYQPDVLPSTLDEEPKV

SEQ ID NO: 29493 - protein, 18 aa, artificial
  peptide fold or domain or sub-domain
MKRPKEHSIQRSANNMPK

SEQ ID NO: 29494 - protein, 29 aa, artificial
  peptide fold or domain or sub-domain
TLLGRDFCQGIYYCVYDGYHWYFDVWGAG

SEQ ID NO: 29495 - protein, 18 aa, artificial
  peptide fold or domain or sub-domain
MDQNNSLPPYAQGLASPQ

SEQ ID NO: 29496 - protein, 15 aa, artificial
  peptide fold or domain or sub-domain
MLWKLTDNIKYEDCE

SEQ ID NO: 29497 - protein, 21 aa, artificial
  peptide fold or domain or sub-domain
MSSGANITYASRKRRKPVQKT

SEQ ID NO: 29498 - protein, 12 aa, artificial
  peptide fold or domain or sub-domain
MLNSVAKAMSLP

SEQ ID NO: 29499 - protein, 29 aa, artificial
  peptide fold or domain or sub-domain
MADQVCMPFTNAVIHEGMTLISNLFRAEG

SEQ ID NO: 29500 - protein, 29 aa, artificial
  peptide fold or domain or sub-domain
RLVAKMEAKNSYVRDDAIFIKAIVDLTGL

SEQ ID NO: 29501 - protein, 25 aa, artificial
  peptide fold or domain or sub-domain
MLQRETCPIGLTASKVAIYTNLLTW

SEQ ID NO: 29502 - protein, 17 aa, artificial
  peptide fold or domain or sub-domain
IKAPRMGTFIGVFLPCL

SEQ ID NO: 29503 - protein, 13 aa, artificial
  peptide fold or domain or sub-domain
MSIRVTQKSYKNV

SEQ ID NO: 29504 - protein, 20 aa, artificial
  peptide fold or domain or sub-domain
TQDPRHPEARRLQDETNLSG

SEQ ID NO: 29505 - protein, 20 aa, artificial
  peptide fold or domain or sub-domain
BTKGPZIZTGVLRRASVAZL

SEQ ID NO: 29506 - protein, 15 aa, artificial
  peptide fold or domain or sub-domain
EEPWMSMSSKPKPIE

SEQ ID NO: 29507 - protein, 16 aa, artificial
  peptide fold or domain or sub-domain
BSGZPTAVMYILFHKR

SEQ ID NO: 29508 - protein, 14 aa, artificial
  peptide fold or domain or sub-domain
PIKVGDAIPQGEVF

SEQ ID NO: 29509 - protein, 13 aa, artificial
  peptide fold or domain or sub-domain
PMILYWNVRLTHP

SEQ ID NO: 29510 - protein, 27 aa, artificial
  peptide fold or domain or sub-domain
TTEITTTPEPGTPDPYPASPQNLGSSG

SEQ ID NO: 29511 - protein, 12 aa, artificial
  peptide fold or domain or sub-domain
LPBGDFTMQGCP

SEQ ID NO: 29512 - protein, 19 aa, artificial
  peptide fold or domain or sub-domain
MELINDTLWAVMIFTAIFL

SEQ ID NO: 29513 - protein, 20 aa, artificial
  peptide fold or domain or sub-domain
AEQKLGRVRVVDNSALGNAP

SEQ ID NO: 29514 - protein, 14 aa, artificial
  peptide fold or domain or sub-domain
FGFKMGPFRVSDLA

SEQ ID NO: 29515 - protein, 20 aa, artificial
  peptide fold or domain or sub-domain
EDAQETDAWKQDQEIQARDH

SEQ ID NO: 29516 - protein, 20 aa, artificial
  peptide fold or domain or sub-domain
AEGSVVPAPAAGPGEMVFDR

SEQ ID NO: 29517 - protein, 14 aa, artificial
  peptide fold or domain or sub-domain
GREYSPAAEVAEVG

SEQ ID NO: 29518 - protein, 25 aa, artificial
  peptide fold or domain or sub-domain
QTSLTDFYHSKVYLSPGSRSLGLPK

SEQ ID NO: 29519 - protein, 17 aa, artificial
  peptide fold or domain or sub-domain
LHFFFLSSFCWVLTEAW

SEQ ID NO: 29520 - protein, 23 aa, artificial
  peptide fold or domain or sub-domain
QYTCMRGGELFDKRSTASAPDTS

SEQ ID NO: 29521 - protein, 26 aa, artificial
  peptide fold or domain or sub-domain
MPCHREDRTPQGEQDAIRETGLPRGR

SEQ ID NO: 29522 - protein, 24 aa, artificial
  peptide fold or domain or sub-domain
VSLSQVLQISPCIIREEQQLSYPT

SEQ ID NO: 29523 - protein, 29 aa, artificial
  peptide fold or domain or sub-domain
EEGGPLQTSSRTNQMTNQVTLCHFSLPSQ

SEQ ID NO: 29524 - protein, 19 aa, artificial
  peptide fold or domain or sub-domain
MEKWRAWDPQSIQRRKTAK

SEQ ID NO: 29525 - protein, 23 aa, artificial
  peptide fold or domain or sub-domain
MAACPSPKTRRNTSSTAWSRWET

SEQ ID NO: 29526 - protein, 18 aa, artificial
  peptide fold or domain or sub-domain
FSPESMRARDARFLMVRV

SEQ ID NO: 29527 - protein, 26 aa, artificial
  peptide fold or domain or sub-domain
DSLNWMLFFKESELDPLESQSGRTGM

SEQ ID NO: 29528 - protein, 30 aa, artificial
  peptide fold or domain or sub-domain
ETIDPKIKILTGLLYMLSSPKMIPVISLSI

SEQ ID NO: 29529 - protein, 20 aa, artificial
  peptide fold or domain or sub-domain
MLPLSPIEAMVGSGEHGTEV

SEQ ID NO: 29530 - protein, 29 aa, artificial
  peptide fold or domain or sub-domain
HASEEELVSLPLPPSHVKLRRQPDARGCW

SEQ ID NO: 29531 - protein, 21 aa, artificial
  peptide fold or domain or sub-domain
MVQLEDCSIRLTPDDGRQWFP

SEQ ID NO: 29532 - protein, 24 aa, artificial
  peptide fold or domain or sub-domain
MNRPLTFTASVVSTSHEDNMAVYK

SEQ ID NO: 29533 - protein, 30 aa, artificial
  peptide fold or domain or sub-domain
MGGLADPKVPLQSYVSPLQMLWDKLVECLE

SEQ ID NO: 29534 - protein, 19 aa, artificial
  peptide fold or domain or sub-domain
MREIVHIQAGQCGNQIGAK

SEQ ID NO: 29535 - protein, 28 aa, artificial
  peptide fold or domain or sub-domain
SFQFCLDGPRVNTLTSLGMKLKLSGVQL

SEQ ID NO: 29536 - protein, 23 aa, artificial
  peptide fold or domain or sub-domain
SALADNLCPRAPEHFMYNTENNV

SEQ ID NO: 29537 - protein, 27 aa, artificial
  peptide fold or domain or sub-domain
HASDSMLLFKKQIYFQNVQCLKGIGDV

SEQ ID NO: 29538 - protein, 18 aa, artificial
  peptide fold or domain or sub-domain
HKLTCTWLLNPFTPQEDI

SEQ ID NO: 29539 - protein, 20 aa, artificial
  peptide fold or domain or sub-domain
GHANPVSIDRVVDHTSGVSG

SEQ ID NO: 29540 - protein, 20 aa, artificial
  peptide fold or domain or sub-domain
TSSGRGGGARVLVQRLQRQN

SEQ ID NO: 29541 - protein, 29 aa, artificial
  peptide fold or domain or sub-domain
GRVGFNPVNRTSSSNTETILSAVSPFLVR

SEQ ID NO: 29542 - protein, 26 aa, artificial
  peptide fold or domain or sub-domain
LTLRALTLPAPQLFSPVPVSEARSCG

SEQ ID NO: 29543 - protein, 29 aa, artificial
  peptide fold or domain or sub-domain
GPVLTRPHGWPFASMATVVSAALSDPMLT

SEQ ID NO: 29544 - protein, 19 aa, artificial
  peptide fold or domain or sub-domain
GGGISNYGDIFPPWPVFER

SEQ ID NO: 29545 - protein, 27 aa, artificial
  peptide fold or domain or sub-domain
GPNLHTGLWPFSVSLHVTVLPQQMVTD

SEQ ID NO: 29546 - protein, 19 aa, artificial
  peptide fold or domain or sub-domain
RMEDAAENIRMNGWLLLGA

SEQ ID NO: 29547 - protein, 20 aa, artificial
  peptide fold or domain or sub-domain
RQEAGDRVSVGVFRHLSVCA

SEQ ID NO: 29548 - protein, 30 aa, artificial
  peptide fold or domain or sub-domain
PRVRKSVSASLFIEDSHRAICSLQPTLSSA

SEQ ID NO: 29549 - protein, 25 aa, artificial
  peptide fold or domain or sub-domain
ANRRTAPRSSSVDFSWNTPERFPHL

SEQ ID NO: 29550 - protein, 28 aa, artificial
  peptide fold or domain or sub-domain
MVPGLLCSLAAIPRQYGALDSASLGMSS

SEQ ID NO: 29551 - protein, 26 aa, artificial
  peptide fold or domain or sub-domain
MLSVNATSAVVPFCMLCKASIDRSKR

SEQ ID NO: 29552 - protein, 29 aa, artificial
  peptide fold or domain or sub-domain
MSSGSDCGRSYQESNRELVRQQGAESGGL

SEQ ID NO: 29553 - protein, 29 aa, artificial
  peptide fold or domain or sub-domain
MAQWVRALASLQKILNSNPSNRMVAHSPL

SEQ ID NO: 29554 - protein, 22 aa, artificial
  peptide fold or domain or sub-domain
MVGRGRFIAIAAGDLSEGPLSE

SEQ ID NO: 29555 - protein, 21 aa, artificial
  peptide fold or domain or sub-domain
MLNCDISTALHLLPRGSSPCW

SEQ ID NO: 29556 - protein, 21 aa, artificial
  peptide fold or domain or sub-domain
PSELPQTVEVEGGDVGDEVAA

SEQ ID NO: 29557 - protein, 20 aa, artificial
  peptide fold or domain or sub-domain
MATITCTRFTEEYQLFEELG

SEQ ID NO: 29558 - protein, 15 aa, artificial
  peptide fold or domain or sub-domain
MRYTGLMGILLTWST

SEQ ID NO: 29559 - protein, 21 aa, artificial
  peptide fold or domain or sub-domain
SGPEDPARLLQPERGRLSHYS

SEQ ID NO: 29560 - protein, 24 aa, artificial
  peptide fold or domain or sub-domain
MPCSRALILGVPALNTMLSLCGGE

SEQ ID NO: 29561 - protein, 27 aa, artificial
  peptide fold or domain or sub-domain
MRSASIEHSQHKASNFKTTSGVKHFSH

SEQ ID NO: 29562 - protein, 20 aa, artificial
  peptide fold or domain or sub-domain
VFSAAKRPGKPYCQARIDSK

SEQ ID NO: 29563 - protein, 26 aa, artificial
  peptide fold or domain or sub-domain
MVTDSFLLMMLRHAFSHVTRVYASYL

SEQ ID NO: 29564 - protein, 30 aa, artificial
  peptide fold or domain or sub-domain
EHRCIDPSTSEPPNGACFPHPFTDVFGLSV

SEQ ID NO: 29565 - protein, 27 aa, artificial
  peptide fold or domain or sub-domain
MASLPVVGSQVPADRGYLGPRPAVQEH

SEQ ID NO: 29566 - protein, 25 aa, artificial
  peptide fold or domain or sub-domain
MACVKQLQLLPAVHMCAAPRVKLPA

SEQ ID NO: 29567 - protein, 28 aa, artificial
  peptide fold or domain or sub-domain
GRVGRPTRPGSPSEEVVGSQPECQPAVA

SEQ ID NO: 29568 - protein, 23 aa, artificial
  peptide fold or domain or sub-domain
MTKRTVCSAATTGFNQLKVVIQP

SEQ ID NO: 29569 - protein, 28 aa, artificial
  peptide fold or domain or sub-domain
MRPNEPCKQMFVTTLRWRAQNYEQPFCQ

SEQ ID NO: 29570 - protein, 26 aa, artificial
  peptide fold or domain or sub-domain
MGTTYTQQVNEDFNAVGFGLVLQQDY

SEQ ID NO: 29571 - protein, 25 aa, artificial
  peptide fold or domain or sub-domain
PTRPVQHNDSLNVTLAYPVYAQQRR

SEQ ID NO: 29572 - protein, 22 aa, artificial
  peptide fold or domain or sub-domain
MKQQFSNDINKAYSVDASLDHF

SEQ ID NO: 29573 - protein, 26 aa, artificial
  peptide fold or domain or sub-domain
QKHPQVASPLQTLATRRRKRSATDPF

SEQ ID NO: 29574 - protein, 24 aa, artificial
  peptide fold or domain or sub-domain
KMQAFRIWDTNQKDTKLQLEEVNI

SEQ ID NO: 29575 - protein, 14 aa, artificial
  peptide fold or domain or sub-domain
VQIHHDTQHTMYFA

SEQ ID NO: 29576 - protein, 18 aa, artificial
  peptide fold or domain or sub-domain
HGGSQPSVMGSDALFWCV

SEQ ID NO: 29577 - protein, 27 aa, artificial
  peptide fold or domain or sub-domain
MACYPVNIRARGLGKNMGMKSRGRGKG

SEQ ID NO: 29578 - protein, 28 aa, artificial
  peptide fold or domain or sub-domain
KVEARARYLKDPFMHKNATPNSPHVPKP

SEQ ID NO: 29579 - protein, 18 aa, artificial
  peptide fold or domain or sub-domain
MGTWILFACLLGAAFAMP

SEQ ID NO: 29580 - protein, 28 aa, artificial
  peptide fold or domain or sub-domain
WLAGLVFVSEADPVSTGDAKCPLMVQSP

SEQ ID NO: 29581 - protein, 21 aa, artificial
  peptide fold or domain or sub-domain
LHSRLEGLKDELWRNRGYDLR

SEQ ID NO: 29582 - protein, 27 aa, artificial
  peptide fold or domain or sub-domain
MQVRGVCLAAGWFLLALCLWGSPQRLR

SEQ ID NO: 29583 - protein, 17 aa, artificial
  peptide fold or domain or sub-domain
EKGLLYPKFGFQWLKFY

SEQ ID NO: 29584 - protein, 20 aa, artificial
  peptide fold or domain or sub-domain
FSFDNDDEGKDPAVIKSLTL

SEQ ID NO: 29585 - protein, 22 aa, artificial
  peptide fold or domain or sub-domain
QATRARTELLNVFADAKREKPK

SEQ ID NO: 29586 - protein, 22 aa, artificial
  peptide fold or domain or sub-domain
QATRAETENLNVDMDAKHHKEK

SEQ ID NO: 29587 - protein, 19 aa, artificial
  peptide fold or domain or sub-domain
AKIIIVPPAMFQSHLYIFK

SEQ ID NO: 29588 - protein, 15 aa, artificial
  peptide fold or domain or sub-domain
TELTKCKVSHAIKDI

SEQ ID NO: 29589 - protein, 16 aa, artificial
  peptide fold or domain or sub-domain
RVSFADNQGLALTMVK

SEQ ID NO: 29590 - protein, 20 aa, artificial
  peptide fold or domain or sub-domain
LHITQQDNYSVYNTTPSATQ

SEQ ID NO: 29591 - protein, 26 aa, artificial
  peptide fold or domain or sub-domain
QAEDIRDIYDFRDVLGTGAFSEVILT

SEQ ID NO: 29592 - protein, 25 aa, artificial
  peptide fold or domain or sub-domain
GKDSKVRPKVNVSPYVHFMFDFRNQ

SEQ ID NO: 29593 - protein, 19 aa, artificial
  peptide fold or domain or sub-domain
FNQVSITNDDTGYILQTDI

SEQ ID NO: 29594 - protein, 19 aa, artificial
  peptide fold or domain or sub-domain
YCQRQGVPMNSLRFLFEGQ

SEQ ID NO: 29595 - protein, 27 aa, artificial
  peptide fold or domain or sub-domain
MLWVHTQGKKKVEDCKMNGGTPTCAPC

SEQ ID NO: 29596 - protein, 24 aa, artificial
  peptide fold or domain or sub-domain
SFTIGKSVWLLWALVFQNSVPIEN

SEQ ID NO: 29597 - protein, 27 aa, artificial
  peptide fold or domain or sub-domain
HSDAVATWLKPDPSQKASLEHQSHEFH

SEQ ID NO: 29598 - protein, 27 aa, artificial
  peptide fold or domain or sub-domain
QNKHTCSGSRASNLPRSSLPTPVSQTP

SEQ ID NO: 29599 - protein, 24 aa, artificial
  peptide fold or domain or sub-domain
SPTSPDKKAKRHEVKSDPTPFGLR

SEQ ID NO: 29600 - protein, 20 aa, artificial
  peptide fold or domain or sub-domain
DISSNTAGKVRAWHGRDVTL

SEQ ID NO: 29601 - protein, 16 aa, artificial
  peptide fold or domain or sub-domain
MYVLHSWKSGEGIRFP

SEQ ID NO: 29602 - protein, 24 aa, artificial
  peptide fold or domain or sub-domain
CSPMECFSWQGLWLQPSVHLQNSR

SEQ ID NO: 29603 - protein, 14 aa, artificial
  peptide fold or domain or sub-domain
SLDLQACSQSLDYV

SEQ ID NO: 29604 - protein, 29 aa, artificial
  peptide fold or domain or sub-domain
MVNISMCLHVCLFIKFWGDLGRHWHAAVG

SEQ ID NO: 29605 - protein, 12 aa, artificial
  peptide fold or domain or sub-domain
GYNVYGIESVKI

SEQ ID NO: 29606 - protein, 12 aa, artificial
  peptide fold or domain or sub-domain
DQVSHHARLKTD

SEQ ID NO: 29607 - protein, 21 aa, artificial
  peptide fold or domain or sub-domain
SFATCAKTYKNISRIKRETLV

SEQ ID NO: 29608 - protein, 16 aa, artificial
  peptide fold or domain or sub-domain
TFKPIVSKDTEKTNVW

SEQ ID NO: 29609 - protein, 30 aa, artificial
  peptide fold or domain or sub-domain
HFGLHSSSVSCVLQIVSYISGILSFWANIH

SEQ ID NO: 29610 - protein, 25 aa, artificial
  peptide fold or domain or sub-domain
KFSVFQWRGLFNFRKFENSFPIICK

SEQ ID NO: 29611 - protein, 18 aa, artificial
  peptide fold or domain or sub-domain
KKINNTILSGLDSVASFS

SEQ ID NO: 29612 - protein, 27 aa, artificial
  peptide fold or domain or sub-domain
QSAAFKSFISSTVAQPSEMPPSPLVWE

SEQ ID NO: 29613 - protein, 23 aa, artificial
  peptide fold or domain or sub-domain
KSSKKTPPRLFNAVHTSPHGICF

SEQ ID NO: 29614 - protein, 27 aa, artificial
  peptide fold or domain or sub-domain
TKQSWRSEHTGLRAPRTRRPPRALADI

SEQ ID NO: 29615 - protein, 14 aa, artificial
  peptide fold or domain or sub-domain
IKKRGTMMLTLSLK

SEQ ID NO: 29616 - protein, 17 aa, artificial
  peptide fold or domain or sub-domain
GRVLHGGVWQRVNPKFT

SEQ ID NO: 29617 - protein, 19 aa, artificial
  peptide fold or domain or sub-domain
NYNQGKLIFGQGTKLSIKP

SEQ ID NO: 29618 - protein, 19 aa, artificial
  peptide fold or domain or sub-domain
TQMLTKSSLEKGHIFMFSL

SEQ ID NO: 29619 - protein, 21 aa, artificial
  peptide fold or domain or sub-domain
MAEAHQAVAFQFTVTPDGVDF

SEQ ID NO: 29620 - protein, 11 aa, artificial
  peptide fold or domain or sub-domain
YGIATPKGSAL

SEQ ID NO: 29621 - protein, 20 aa, artificial
  peptide fold or domain or sub-domain
MEGPAFSKPLKDKINPWAPL

SEQ ID NO: 29622 - protein, 30 aa, artificial
  peptide fold or domain or sub-domain
MRKDLEKVSQVNLWNTLKEQLEKITPNFLS

SEQ ID NO: 29623 - protein, 13 aa, artificial
  peptide fold or domain or sub-domain
MAPKQDPKPKFQE

SEQ ID NO: 29624 - protein, 17 aa, artificial
  peptide fold or domain or sub-domain
NTGKLTFGDGTVLTVKP

SEQ ID NO: 29625 - protein, 25 aa, artificial
  peptide fold or domain or sub-domain
SHRLPTLDDRSKMPYTDAVIHEIQR

SEQ ID NO: 29626 - protein, 26 aa, artificial
  peptide fold or domain or sub-domain
DRLCVQVSAVTSRVLCSLYTPVSHVP

SEQ ID NO: 29627 - protein, 25 aa, artificial
  peptide fold or domain or sub-domain
EGRDETTLKIRRADDKTSPQCWSLH

SEQ ID NO: 29628 - protein, 19 aa, artificial
  peptide fold or domain or sub-domain
ITLVMEMSCKDVENKASFP

SEQ ID NO: 29629 - protein, 18 aa, artificial
  peptide fold or domain or sub-domain
MIFIVAERRQGVLTLGAV

SEQ ID NO: 29630 - protein, 13 aa, artificial
  peptide fold or domain or sub-domain
QICSLNSINSMCK

SEQ ID NO: 29631 - protein, 17 aa, artificial
  peptide fold or domain or sub-domain
RKATRGISPQELGQGLS

SEQ ID NO: 29632 - protein, 29 aa, artificial
  peptide fold or domain or sub-domain
MPGKPVLHYFDGRGRMEPIRWLLAAAGVE

SEQ ID NO: 29633 - protein, 23 aa, artificial
  peptide fold or domain or sub-domain
LMTHMWFVMHQPHAGNPKNNPVK

SEQ ID NO: 29634 - protein, 27 aa, artificial
  peptide fold or domain or sub-domain
ETQKYLSPPERKRRAKMLQLSERQVKT

SEQ ID NO: 29635 - protein, 22 aa, artificial
  peptide fold or domain or sub-domain
FAHPADSTMIDTNDNTVTVCMD

SEQ ID NO: 29636 - protein, 24 aa, artificial
  peptide fold or domain or sub-domain
MSYVTLNIMLAYTFSLLGPFMFRS

SEQ ID NO: 29637 - protein, 17 aa, artificial
  peptide fold or domain or sub-domain
CASGDAGHSGNTLYFGE

SEQ ID NO: 29638 - protein, 17 aa, artificial
  peptide fold or domain or sub-domain
CAAGIRMDYANKMIFGL

SEQ ID NO: 29639 - protein, 25 aa, artificial
  peptide fold or domain or sub-domain
GTRVSGGAAGRETYSLTRLFAPGSS

SEQ ID NO: 29640 - protein, 25 aa, artificial
  peptide fold or domain or sub-domain
HTHTVGGQSRARRLSFAGLFYYGPK

SEQ ID NO: 29641 - protein, 27 aa, artificial
  peptide fold or domain or sub-domain
ETHTTGGSAARPRTDFVNLFSHPNAMN

SEQ ID NO: 29642 - protein, 27 aa, artificial
  peptide fold or domain or sub-domain
TTYVSGGAQSQTISKFVGFLSQGSAQN

SEQ ID NO: 29643 - protein, 27 aa, artificial
  peptide fold or domain or sub-domain
ETHTTGGSAARTTHRLVQPLSVTRQQN

SEQ ID NO: 29644 - protein, 27 aa, artificial
  peptide fold or domain or sub-domain
EYPWRGAVQRPRLRSFTSIFSPGAKQP

SEQ ID NO: 29645 - protein, 27 aa, artificial
  peptide fold or domain or sub-domain
ETYTTGGVASQLTSKFANFFSLGAQQK

SEQ ID NO: 29646 - protein, 27 aa, artificial
  peptide fold or domain or sub-domain
DTYALGGAAGTPPAGSWASLDLGPLRG

SEQ ID NO: 29647 - protein, 26 aa, artificial
  peptide fold or domain or sub-domain
TTYTSGGDSPQHLRVHVPLYIWVLSE

SEQ ID NO: 29648 - protein, 27 aa, artificial
  peptide fold or domain or sub-domain
MIINTLAPEKIPFALPSHKRCFSKRSS

SEQ ID NO: 29649 - protein, 21 aa, artificial
  peptide fold or domain or sub-domain
MDGFCIQSSDEGSRKQSLYIV

SEQ ID NO: 29650 - protein, 27 aa, artificial
  peptide fold or domain or sub-domain
ASSGVGLAQAVNTHGFVSFLTPGARQN

SEQ ID NO: 29651 - protein, 30 aa, artificial
  peptide fold or domain or sub-domain
MVDRTRHYTCCASGQNPTTRQPTPHDLRGS

SEQ ID NO: 29652 - protein, 22 aa, artificial
  peptide fold or domain or sub-domain
MSLLTEVETPTKTDWECKCSDS

SEQ ID NO: 29653 - protein, 14 aa, artificial
  peptide fold or domain or sub-domain
MDAMLGTHIIGDFG

SEQ ID NO: 29654 - protein, 20 aa, artificial
  peptide fold or domain or sub-domain
MDIDPYERIWSYCGVTLVFA

SEQ ID NO: 29655 - protein, 23 aa, artificial
  peptide fold or domain or sub-domain
MQRPRPPRPLIYSRSSEEAFLEA

SEQ ID NO: 29656 - protein, 30 aa, artificial
  peptide fold or domain or sub-domain
TLSLPPSNYLDSSACNLTPGPQSHTAKPAN

SEQ ID NO: 29657 - protein, 30 aa, artificial
  peptide fold or domain or sub-domain
KPSLLPQIHPNTLTRSRPLDLRPYMTTPSN

SEQ ID NO: 29658 - protein, 27 aa, artificial
  peptide fold or domain or sub-domain
VTHVTGGSAGHTVAGFASLFNQGAKQN

SEQ ID NO: 29659 - protein, 27 aa, artificial
  peptide fold or domain or sub-domain
GTAVMGGRQAYSAHTVTSFFTVGPAQS

SEQ ID NO: 29660 - protein, 27 aa, artificial
  peptide fold or domain or sub-domain
DTRTIGESAARTASTLSRILDRGPKQD

SEQ ID NO: 29661 - protein, 27 aa, artificial
  peptide fold or domain or sub-domain
DTHVTGGTAGRAASTFAGFFSQGASQN

SEQ ID NO: 29662 - protein, 27 aa, artificial
  peptide fold or domain or sub-domain
TTLVSGGAPARAASGLVSFFSPGAKQK

SEQ ID NO: 29663 - protein, 27 aa, artificial
  peptide fold or domain or sub-domain
DTYTTGGSAAQAVSGLVSLFQPGAKQN

SEQ ID NO: 29664 - protein, 27 aa, artificial
  peptide fold or domain or sub-domain
NTRVTGGSAAQSTASFAGFFATGASQN

SEQ ID NO: 29665 - protein, 27 aa, artificial
  peptide fold or domain or sub-domain
ETHVTGGAAGHTISGFRGLFVQGPKQN

SEQ ID NO: 29666 - protein, 27 aa, artificial
  peptide fold or domain or sub-domain
HTYATGAAQSCTTMQFASLFNLGPTQK

SEQ ID NO: 29667 - protein, 30 aa, artificial
  peptide fold or domain or sub-domain
MQGVSDCKAPTPCGNRIGTQVGTLHDIKRL

SEQ ID NO: 29668 - protein, 29 aa, artificial
  peptide fold or domain or sub-domain
MLTVKIINGDGAIDKHLTLNEKEAFKKTI

SEQ ID NO: 29669 - protein, 29 aa, artificial
  peptide fold or domain or sub-domain
MFCYIVGVSKCLRDIQTHAEYINDKAGFF

SEQ ID NO: 29670 - protein, 15 aa, artificial
  peptide fold or domain or sub-domain
ILLPLEGISFPKFEN

SEQ ID NO: 29671 - protein, 15 aa, artificial
  peptide fold or domain or sub-domain
PLLPLERVSFPKFEN

SEQ ID NO: 29672 - protein, 27 aa, artificial
  peptide fold or domain or sub-domain
DTRTVAGQASQITRSFTGLFTPGSSQN

SEQ ID NO: 29673 - protein, 15 aa, artificial
  peptide fold or domain or sub-domain
MAMKAILKGKGGRSP

SEQ ID NO: 29674 - protein, 20 aa, artificial
  peptide fold or domain or sub-domain
MAPPASLSHISQEILFPLIP

SEQ ID NO: 29675 - protein, 27 aa, artificial
  peptide fold or domain or sub-domain
WAVIMLLLLLFMQRCNKYCPAPESYPG

SEQ ID NO: 29676 - protein, 12 aa, artificial
  peptide fold or domain or sub-domain
LAPISVNEDGVE

SEQ ID NO: 29677 - protein, 27 aa, artificial
  peptide fold or domain or sub-domain
ETRIMAQSQARAAQGLANLFSSGASQR

SEQ ID NO: 29678 - protein, 20 aa, artificial
  peptide fold or domain or sub-domain
MNADALSTDSCLSMREPLSH

SEQ ID NO: 29679 - protein, 23 aa, artificial
  peptide fold or domain or sub-domain
MRPPRCMEAPASSTQHPVRVRVI

SEQ ID NO: 29680 - protein, 29 aa, artificial
  peptide fold or domain or sub-domain
MKTTHCFTFCSRSSTGSDRRLKQTERWNS

SEQ ID NO: 29681 - protein, 13 aa, artificial
  peptide fold or domain or sub-domain
MGSQLVQPPSAFN

SEQ ID NO: 29682 - protein, 27 aa, artificial
  peptide fold or domain or sub-domain
MAAQCHHELTTAWYPRSFNNLLRHLNK

SEQ ID NO: 29683 - protein, 30 aa, artificial
  peptide fold or domain or sub-domain
PSQPMEDLEAKIAQLQLENKQLKKRIKHGT

SEQ ID NO: 29684 - protein, 27 aa, artificial
  peptide fold or domain or sub-domain
AVLDISTATDPILSHLLPHSRSCIQWA

SEQ ID NO: 29685 - protein, 17 aa, artificial
  peptide fold or domain or sub-domain
MSTNPKPQKKPTVTPTA

SEQ ID NO: 29686 - protein, 23 aa, artificial
  peptide fold or domain or sub-domain
SPPTRTTHSFSLYPDRFPRRVTV

SEQ ID NO: 29687 - protein, 18 aa, artificial
  peptide fold or domain or sub-domain
MEQRLGYKFLGADPKAGV

SEQ ID NO: 29688 - protein, 21 aa, artificial
  peptide fold or domain or sub-domain
MDIDHTVSVDHPTAASHKSHQ

SEQ ID NO: 29689 - protein, 21 aa, artificial
  peptide fold or domain or sub-domain
ITPELTKLVQHLKPHSHSLGF

SEQ ID NO: 29690 - protein, 17 aa, artificial
  peptide fold or domain or sub-domain
EDKGSRIYTPHLRQGQS

SEQ ID NO: 29691 - protein, 27 aa, artificial
  peptide fold or domain or sub-domain
NTHVTGGVVARNAYRITTFLNPGPAQN

SEQ ID NO: 29692 - protein, 27 aa, artificial
  peptide fold or domain or sub-domain
TTHVTGGSQAHGAYKLTRLFDFGPVQK

SEQ ID NO: 29693 - protein, 19 aa, artificial
  peptide fold or domain or sub-domain
MVCRYHGFRKKHSVRWYRG

SEQ ID NO: 29694 - protein, 27 aa, artificial
  peptide fold or domain or sub-domain
APTASTCIITVSGIQSMPSPLITDTST

SEQ ID NO: 29695 - protein, 19 aa, artificial
  peptide fold or domain or sub-domain
AWRSSSENGRHPLTPKQKR

SEQ ID NO: 29696 - protein, 17 aa, artificial
  peptide fold or domain or sub-domain
MSLLTEVGTYVLSVVPS

SEQ ID NO: 29697 - protein, 19 aa, artificial
  peptide fold or domain or sub-domain
SLSIDSMVKRVFYQTRIVV

SEQ ID NO: 29698 - protein, 14 aa, artificial
  peptide fold or domain or sub-domain
MARARSIKTVGLVG

SEQ ID NO: 29699 - protein, 17 aa, artificial
  peptide fold or domain or sub-domain
MEVCLPNGHQVVDLINA

SEQ ID NO: 29700 - protein, 23 aa, artificial
  peptide fold or domain or sub-domain
HKAEMWSNGSDGLKIKTENRLLI

SEQ ID NO: 29701 - protein, 29 aa, artificial
  peptide fold or domain or sub-domain
TEASTQISDGEWKDSQTTNVDSFEMIAEN

SEQ ID NO: 29702 - protein, 29 aa, artificial
  peptide fold or domain or sub-domain
SEAPTQISDTEWKDTQTTNTATFEIVADS

SEQ ID NO: 29703 - protein, 28 aa, artificial
  peptide fold or domain or sub-domain
MNPPKMCMSCNIQVQLDLIVLYLVLRLS

SEQ ID NO: 29704 - protein, 16 aa, artificial
  peptide fold or domain or sub-domain
QDAGVPQSRFFGAVIG

SEQ ID NO: 29705 - protein, 26 aa, artificial
  peptide fold or domain or sub-domain
NPRDGGGIRPQHLRLRVTLFIWGGLE

SEQ ID NO: 29706 - protein, 21 aa, artificial
  peptide fold or domain or sub-domain
MPRVRFNSINAFYSVIRTFRK

SEQ ID NO: 29707 - protein, 29 aa, artificial
  peptide fold or domain or sub-domain
MSDESERWTFARMMWHEVPDEKKKELKSE

SEQ ID NO: 29708 - protein, 29 aa, artificial
  peptide fold or domain or sub-domain
VTEHHMLCIYHQTINGVRHRGDRVARRQA

SEQ ID NO: 29709 - protein, 29 aa, artificial
  peptide fold or domain or sub-domain
MVFIIHLGLSGGSLRLNSLNCTYMVTRIL

SEQ ID NO: 29710 - protein, 18 aa, artificial
  peptide fold or domain or sub-domain
MASEQELKAIVRDLGCGP

SEQ ID NO: 29711 - protein, 18 aa, artificial
  peptide fold or domain or sub-domain
KLLNSIQTLVVVNAVPSK

SEQ ID NO: 29712 - protein, 27 aa, artificial
  peptide fold or domain or sub-domain
TRVTGGTAAHTFAGLHPSFHWGRPRRI

SEQ ID NO: 29713 - protein, 27 aa, artificial
  peptide fold or domain or sub-domain
TTTMGGVAGHSTLGFVFMFIPGAKQNL

SEQ ID NO: 29714 - protein, 27 aa, artificial
  peptide fold or domain or sub-domain
TFVTGGTVGHNALRLTSLFSSGAFQKI

SEQ ID NO: 29715 - protein, 27 aa, artificial
  peptide fold or domain or sub-domain
TRVTGGTAGRNGYGLTSLFTRGASKKI

SEQ ID NO: 29716 - protein, 27 aa, artificial
  peptide fold or domain or sub-domain
STVVMGGTAAYTTNKFASISNPGAQQN

SEQ ID NO: 29717 - protein, 27 aa, artificial
  peptide fold or domain or sub-domain
NTVLMGTRVGQNAQSFSSFFAPGAKQN

SEQ ID NO: 29718 - protein, 27 aa, artificial
  peptide fold or domain or sub-domain
STHLVGSTSSRAAASFAGLFTSGAQQR

SEQ ID NO: 29719 - protein, 27 aa, artificial
  peptide fold or domain or sub-domain
NTRIVGAKAASAVRGFTSLFSSGPQQN

SEQ ID NO: 29720 - protein, 27 aa, artificial
  peptide fold or domain or sub-domain
TTVMTGQVAGRNLRGFASIFTAGPQQS

SEQ ID NO: 29721 - protein, 27 aa, artificial
  peptide fold or domain or sub-domain
KTYVAGGSAARSASTLANWFSAGPQQD

SEQ ID NO: 29722 - protein, 27 aa, artificial
  peptide fold or domain or sub-domain
HTNVAGTIAHGTHVFTSIFSLGTRQKL

SEQ ID NO: 29723 - protein, 27 aa, artificial
  peptide fold or domain or sub-domain
GTYITGGNTALSTRSLVGIFTAGPQQK

SEQ ID NO: 29724 - protein, 27 aa, artificial
  peptide fold or domain or sub-domain
GTHVTGGTQAAAGNVLYAFLLIGAYQK

SEQ ID NO: 29725 - protein, 26 aa, artificial
  peptide fold or domain or sub-domain
KPTRRGGRSLQHPRLVSMFTLGRSQN

SEQ ID NO: 29726 - protein, 27 aa, artificial
  peptide fold or domain or sub-domain
STTVTGGKSRLCRPQSYVFFSPPGPSQ

SEQ ID NO: 29727 - protein, 27 aa, artificial
  peptide fold or domain or sub-domain
NTMVSGAALRRGALGLRAVFSPGSRQN

SEQ ID NO: 29728 - protein, 26 aa, artificial
  peptide fold or domain or sub-domain
STIVTGPRRHQTSGIANLFATGSSQK

SEQ ID NO: 29729 - protein, 25 aa, artificial
  peptide fold or domain or sub-domain
MASSVRRFQSVSHTSERDTRSLKMA

SEQ ID NO: 29730 - protein, 19 aa, artificial
  peptide fold or domain or sub-domain
MAAGAVSSSAETPPWIRHS

SEQ ID NO: 29731 - protein, 30 aa, artificial
  peptide fold or domain or sub-domain
MASSTPASPAPSDILSRLPQSERPPGRWTC

SEQ ID NO: 29732 - protein, 27 aa, artificial
  peptide fold or domain or sub-domain
ETHTDKSTTARGTRASASLFYMGANQK

SEQ ID NO: 29733 - protein, 27 aa, artificial
  peptide fold or domain or sub-domain
TTYTTGGSAARKIFGIAGLFDAGAKQR

SEQ ID NO: 29734 - protein, 27 aa, artificial
  peptide fold or domain or sub-domain
QTRTVGGHVARVTDSWARLFDAGLKQN

SEQ ID NO: 29735 - protein, 27 aa, artificial
  peptide fold or domain or sub-domain
DTRTIGAVSSQNTRSLVSSLTLGPRQK

SEQ ID NO: 29736 - protein, 27 aa, artificial
  peptide fold or domain or sub-domain
GETGDFHGIYSSQPIRPFLPRVVDPSE

SEQ ID NO: 29737 - protein, 14 aa, artificial
  peptide fold or domain or sub-domain
KTTRPFKFGFGLGE

SEQ ID NO: 29738 - protein, 26 aa, artificial
  peptide fold or domain or sub-domain
CALRLHLCTSHGDHRERPPGLAQGLT

SEQ ID NO: 29739 - protein, 23 aa, artificial
  peptide fold or domain or sub-domain
MAEGAEHQPKLTEKDKAEFPSSI

SEQ ID NO: 29740 - protein, 19 aa, artificial
  peptide fold or domain or sub-domain
MAAGAGPSSAVTPPWIRHS

SEQ ID NO: 29741 - protein, 27 aa, artificial
  peptide fold or domain or sub-domain
MVLEIIIGLCVGYALNDAFCAVPSATM

SEQ ID NO: 29742 - protein, 25 aa, artificial
  peptide fold or domain or sub-domain
MGFSNVYACNPFPSATFVTQHFLYQ

SEQ ID NO: 29743 - protein, 27 aa, artificial
  peptide fold or domain or sub-domain
MENCAEGLYLREDLSLGGVGYLPAKAG

SEQ ID NO: 29744 - protein, 23 aa, artificial
  peptide fold or domain or sub-domain
MLPRTGDRWLASYVRYSQYYTLI

SEQ ID NO: 29745 - protein, 27 aa, artificial
  peptide fold or domain or sub-domain
ETHTTGGSAARTTQGLVRFFQPGAKQD

SEQ ID NO: 29746 - protein, 27 aa, artificial
  peptide fold or domain or sub-domain
DTHTTGGSAARTTQGLVRFFSPGAKQD

SEQ ID NO: 29747 - protein, 27 aa, artificial
  peptide fold or domain or sub-domain
ATHVTGGAAARTTSGLTSLFHLGPSQK

SEQ ID NO: 29748 - protein, 27 aa, artificial
  peptide fold or domain or sub-domain
NTYVTGGSTGHTASGLVNLFSPGSRQN

SEQ ID NO: 29749 - protein, 27 aa, artificial
  peptide fold or domain or sub-domain
GTHVTGGKAGHTIHGFTSLFTRGSAQN

SEQ ID NO: 29750 - protein, 27 aa, artificial
  peptide fold or domain or sub-domain
STHVTGGSVARKTYGFASLFDPGPSQK

SEQ ID NO: 29751 - protein, 27 aa, artificial
  peptide fold or domain or sub-domain
AYVMGAAQARTTHGWTTLFSSGASQKI

SEQ ID NO: 29752 - protein, 27 aa, artificial
  peptide fold or domain or sub-domain
THVTGEAPARAANSLSSLFSAGSQQNI

SEQ ID NO: 29753 - protein, 27 aa, artificial
  peptide fold or domain or sub-domain
SPRVTGREAARHTTSFTRMFTPGSKQN

SEQ ID NO: 29754 - protein, 27 aa, artificial
  peptide fold or domain or sub-domain
TTHVVVGKVARTVQGFTSFLSPGPSQK

SEQ ID NO: 29755 - protein, 27 aa, artificial
  peptide fold or domain or sub-domain
YTYTTGGAVAHGARGITSLFVSGPKQN

SEQ ID NO: 29756 - protein, 27 aa, artificial
  peptide fold or domain or sub-domain
STVVTGGTAAHTTQRVAGLFAPGPAQT

SEQ ID NO: 29757 - protein, 22 aa, artificial
  peptide fold or domain or sub-domain
RRRCMRGTSLSLPWHGDMDRKE

SEQ ID NO: 29758 - protein, 26 aa, artificial
  peptide fold or domain or sub-domain
NKDEVFDEKCFSVDEIGTLPLCILSL

SEQ ID NO: 29759 - protein, 27 aa, artificial
  peptide fold or domain or sub-domain
PLQPLPDETTPRRGGERALPERAPDQD

SEQ ID NO: 29760 - protein, 27 aa, artificial
  peptide fold or domain or sub-domain
PLQHVPDAGPPLRGGARSQPHREAGED

SEQ ID NO: 29761 - protein, 27 aa, artificial
  peptide fold or domain or sub-domain
RRQQVHHQGQAEENFGRHQLIRTPGHH

SEQ ID NO: 29762 - protein, 18 aa, artificial
  peptide fold or domain or sub-domain
CHDPTEQVDAASCLQPKM

SEQ ID NO: 29763 - protein, 14 aa, artificial
  peptide fold or domain or sub-domain
REQLSGLTDIPESR

SEQ ID NO: 29764 - protein, 24 aa, artificial
  peptide fold or domain or sub-domain
MCLKEPFLLPTVLSIVVALMMHHG

SEQ ID NO: 29765 - protein, 22 aa, artificial
  peptide fold or domain or sub-domain
YFLFFISNPLLGLLENKISNYH

SEQ ID NO: 29766 - protein, 29 aa, artificial
  peptide fold or domain or sub-domain
MSNRGASLKSLFLAVLLVSNTLLTKEGVT

SEQ ID NO: 29767 - protein, 30 aa, artificial
  peptide fold or domain or sub-domain
CGRLYGLGSGSSQTQNGISNSSQEEANNKH

SEQ ID NO: 29768 - protein, 25 aa, artificial
  peptide fold or domain or sub-domain
RPPQEDGTEKEQLQPQENGDKSTET

SEQ ID NO: 29769 - protein, 23 aa, artificial
  peptide fold or domain or sub-domain
CGDYEMFSEAVEEDTVEKFLKIA

SEQ ID NO: 29770 - protein, 27 aa, artificial
  peptide fold or domain or sub-domain
QFLPMTLALCLWHVAFPTSMFLLPPQQ

SEQ ID NO: 29771 - protein, 11 aa, artificial
  peptide fold or domain or sub-domain
FTLKTNPSRSL

SEQ ID NO: 29772 - protein, 13 aa, artificial
  peptide fold or domain or sub-domain
KTRDGSTKKGLDE

SEQ ID NO: 29773 - protein, 30 aa, artificial
  peptide fold or domain or sub-domain
MLCRDHGRFIFITLTLLIFHCYKGLALEAA

SEQ ID NO: 29774 - protein, 27 aa, artificial
  peptide fold or domain or sub-domain
RPESRVDNLSQPWPRTWSEPGERSKWG

SEQ ID NO: 29775 - protein, 26 aa, artificial
  peptide fold or domain or sub-domain
QPILYEGQDKNPEMCRVLLTHEIMCR

SEQ ID NO: 29776 - protein, 30 aa, artificial
  peptide fold or domain or sub-domain
MLDSAVAALLLLTVVGLCSSLETPDSPSAR

SEQ ID NO: 29777 - protein, 29 aa, artificial
  peptide fold or domain or sub-domain
FESIIEGLLDPKLLEDLKQFKGKVFFCVL

SEQ ID NO: 29778 - protein, 27 aa, artificial
  peptide fold or domain or sub-domain
SRGCDVHWPRHPRHPCHGRLNREQAYR

SEQ ID NO: 29779 - protein, 30 aa, artificial
  peptide fold or domain or sub-domain
RSPPGLAKTPLSALGLKPHNPAEIHLNQTG

SEQ ID NO: 29780 - protein, 24 aa, artificial
  peptide fold or domain or sub-domain
LTCPPGLPCPYQRMSRKGKEMVIR

SEQ ID NO: 29781 - protein, 27 aa, artificial
  peptide fold or domain or sub-domain
TPNLHPNCPSKLRRSMMNSSARMLPAR

SEQ ID NO: 29782 - protein, 28 aa, artificial
  peptide fold or domain or sub-domain
DPLEDMLFNEVDEKAVSDLVGSLESQLG

SEQ ID NO: 29783 - protein, 24 aa, artificial
  peptide fold or domain or sub-domain
QIASYPSESRGLSLRLLGIEEASC

SEQ ID NO: 29784 - protein, 29 aa, artificial
  peptide fold or domain or sub-domain
WVWKQLVGEVLVRTFTGGHWMMAKKKQKP

SEQ ID NO: 29785 - protein, 26 aa, artificial
  peptide fold or domain or sub-domain
GVVWLGYPSLEGPHITKKPRLFDGHQ

SEQ ID NO: 29786 - protein, 30 aa, artificial
  peptide fold or domain or sub-domain
ARAMIGGPRTHIPFLTTKQSICPSSRSQRW

SEQ ID NO: 29787 - protein, 30 aa, artificial
  peptide fold or domain or sub-domain
YDGLGWGILRTLKKGWPHGLGKVDKELAQI

SEQ ID NO: 29788 - protein, 27 aa, artificial
  peptide fold or domain or sub-domain
RMVSHMPIISMLRQDSNWHALTLAQPR

SEQ ID NO: 29789 - protein, 26 aa, artificial
  peptide fold or domain or sub-domain
TTLKRASTLSERGKKGTHSSSFQKER

SEQ ID NO: 29790 - protein, 24 aa, artificial
  peptide fold or domain or sub-domain
HDDAAKQCRDLSQELVNLRGELGK

SEQ ID NO: 29791 - protein, 27 aa, artificial
  peptide fold or domain or sub-domain
AHQASLRPSNRSVPAPNHIQKGDNCPP

SEQ ID NO: 29792 - protein, 28 aa, artificial
  peptide fold or domain or sub-domain
TRHCPSLSRWGTCHPKPELSGAVFGVKD

SEQ ID NO: 29793 - protein, 30 aa, artificial
  peptide fold or domain or sub-domain
QGLKAMDSNGLADPYVKLHLLPGASKVTKL

SEQ ID NO: 29794 - protein, 26 aa, artificial
  peptide fold or domain or sub-domain
GGVISSVLRKRDGISRSAPRLLCTLE

SEQ ID NO: 29795 - protein, 30 aa, artificial
  peptide fold or domain or sub-domain
RKIVKYAPVVRGESKQPFSSFRRSSLLLIN

SEQ ID NO: 29796 - protein, 24 aa, artificial
  peptide fold or domain or sub-domain
TGATCDDHSQMTRKGLKVAAATRS

SEQ ID NO: 29797 - protein, 29 aa, artificial
  peptide fold or domain or sub-domain
LCTSPADKLVFASIMNAYKVMEEGHKATF

SEQ ID NO: 29798 - protein, 29 aa, artificial
  peptide fold or domain or sub-domain
PSRRFKRVVETIQSQLLSTHDQPGVQQLS

SEQ ID NO: 29799 - protein, 25 aa, artificial
  peptide fold or domain or sub-domain
EGKCGGEGHIETKHTAHKQHSWRNH

SEQ ID NO: 29800 - protein, 27 aa, artificial
  peptide fold or domain or sub-domain
NGLPPRHQTCHRELHLHHGRRSFPPCE

SEQ ID NO: 29801 - protein, 24 aa, artificial
  peptide fold or domain or sub-domain
MSSCDLHSQEDESPRSVLEEMGLA

SEQ ID NO: 29802 - protein, 28 aa, artificial
  peptide fold or domain or sub-domain
MTTWTFFPASVCSEAKTPSINCDFGIPC

SEQ ID NO: 29803 - protein, 28 aa, artificial
  peptide fold or domain or sub-domain
MNVFFYKAAINLDRDHPLPPPPNDLGFT

SEQ ID NO: 29804 - protein, 28 aa, artificial
  peptide fold or domain or sub-domain
MRKKAGDLAITALSWATGSQPVAEGLLV

SEQ ID NO: 29805 - protein, 26 aa, artificial
  peptide fold or domain or sub-domain
MASVTAASRLLSKRLLTKTLPVSISS

SEQ ID NO: 29806 - protein, 24 aa, artificial
  peptide fold or domain or sub-domain
MHKPLRKRGLYVFLSFGIIYLELG

SEQ ID NO: 29807 - protein, 28 aa, artificial
  peptide fold or domain or sub-domain
MTAGTQGTGGRLISHVCSFAKVALSQGN

SEQ ID NO: 29808 - protein, 29 aa, artificial
  peptide fold or domain or sub-domain
MRRIIHVLRSYVPFSELVAPWELFSTEPR

SEQ ID NO: 29809 - protein, 27 aa, artificial
  peptide fold or domain or sub-domain
MAAPGVILSPFPKEKGEICHACYPSRH

SEQ ID NO: 29810 - protein, 30 aa, artificial
  peptide fold or domain or sub-domain
METEQQWERYGKARRKRARKHKYWLSGHVF

SEQ ID NO: 29811 - protein, 25 aa, artificial
  peptide fold or domain or sub-domain
MVHQLKDAPGECFSFPPKRAAHLTR

SEQ ID NO: 29812 - protein, 30 aa, artificial
  peptide fold or domain or sub-domain
MRRWQHVIQVVAAFYQCRMDGWTCSEISSN

SEQ ID NO: 29813 - protein, 30 aa, artificial
  peptide fold or domain or sub-domain
MAGESKLTGTDSLGAVTKERTPPCILPSPR

SEQ ID NO: 29814 - protein, 27 aa, artificial
  peptide fold or domain or sub-domain
MTRSEDRETASCCTARAREGAEAGEDG

SEQ ID NO: 29815 - protein, 27 aa, artificial
  peptide fold or domain or sub-domain
MASGKWEAEGYRNENGVSGGIVIDIMK

SEQ ID NO: 29816 - protein, 29 aa, artificial
  peptide fold or domain or sub-domain
MGAQRGLVRDHEPLETPWSITQSERLTWS

SEQ ID NO: 29817 - protein, 28 aa, artificial
  peptide fold or domain or sub-domain
MAAEGCEEISGNGEFQDSSGSFIFLNAV

SEQ ID NO: 29818 - protein, 29 aa, artificial
  peptide fold or domain or sub-domain
MIIKGDLDRMAEDIGHAGKSQQAASCQGG

SEQ ID NO: 29819 - protein, 29 aa, artificial
  peptide fold or domain or sub-domain
MSTAGFNSQNGTGTGQSYTNGKYYFKYTN

SEQ ID NO: 29820 - protein, 29 aa, artificial
  peptide fold or domain or sub-domain
MEEIWPILGGEELGRGGLAVQRKGKRERG

SEQ ID NO: 29821 - protein, 28 aa, artificial
  peptide fold or domain or sub-domain
MEVYIQKVQRRVNNHCEKLIGDKAPLPT

SEQ ID NO: 29822 - protein, 29 aa, artificial
  peptide fold or domain or sub-domain
LVLPLIVSSLVTGQTGNSKTPPKRSNPSG

SEQ ID NO: 29823 - protein, 30 aa, artificial
  peptide fold or domain or sub-domain
MKRLCPCFSLLSLTVGILSPVHSSQESQRK

SEQ ID NO: 29824 - protein, 29 aa, artificial
  peptide fold or domain or sub-domain
MLRWPLTAWSLSWTLFICSLTGASAQDRP

SEQ ID NO: 29825 - protein, 26 aa, artificial
  peptide fold or domain or sub-domain
MRTYSIVILLVTLSTACRTEVLQLCR

SEQ ID NO: 29826 - protein, 29 aa, artificial
  peptide fold or domain or sub-domain
MSMLDDLSMNNISEIQSGAFQRLHLLSEL

SEQ ID NO: 29827 - protein, 24 aa, artificial
  peptide fold or domain or sub-domain
MDGNKGKSRFHNKWDVITLTAIFK

SEQ ID NO: 29828 - protein, 27 aa, artificial
  peptide fold or domain or sub-domain
MVALHGVRQFRVFSALVVGSIVCCAKR

SEQ ID NO: 29829 - protein, 24 aa, artificial
  peptide fold or domain or sub-domain
MGEWTILERLLEAAVQQHSTMIGR

SEQ ID NO: 29830 - protein, 25 aa, artificial
  peptide fold or domain or sub-domain
SSVDSDDSIELEIRRFLAEKAKVST

SEQ ID NO: 29831 - protein, 27 aa, artificial
  peptide fold or domain or sub-domain
MDLLGIVACGILGYLKVTRRFPSGHRS

SEQ ID NO: 29832 - protein, 24 aa, artificial
  peptide fold or domain or sub-domain
MSAGSRNTNTEPWGGFDDNLVQVS

SEQ ID NO: 29833 - protein, 28 aa, artificial
  peptide fold or domain or sub-domain
MERWEGAQDPAIQWDRCWEGVCGTPALF

SEQ ID NO: 29834 - protein, 28 aa, artificial
  peptide fold or domain or sub-domain
MWREQPSKRVTTDQRGEAGRSLTIITSS

SEQ ID NO: 29835 - protein, 27 aa, artificial
  peptide fold or domain or sub-domain
MALIIAWCKFDQNTSRIPQLPDDELAY

SEQ ID NO: 29836 - protein, 25 aa, artificial
  peptide fold or domain or sub-domain
MEIRPDRFKVAAAKTLGKIYGYVNA

SEQ ID NO: 29837 - protein, 27 aa, artificial
  peptide fold or domain or sub-domain
MHISGHTLMTTLVALSFAQGCECVCVC

SEQ ID NO: 29838 - protein, 27 aa, artificial
  peptide fold or domain or sub-domain
MVGNLTLPWAVACFCLGSGEWDQAGDT

SEQ ID NO: 29839 - protein, 27 aa, artificial
  peptide fold or domain or sub-domain
MVPVNLTELEKICREELSVLKSKHPFI

SEQ ID NO: 29840 - protein, 25 aa, artificial
  peptide fold or domain or sub-domain
MGSRMRLEAVKRQDWALTCQEFLNY

SEQ ID NO: 29841 - protein, 26 aa, artificial
  peptide fold or domain or sub-domain
MGERGALCVFVRSQLGKRKRGREENK

SEQ ID NO: 29842 - protein, 28 aa, artificial
  peptide fold or domain or sub-domain
MAVLLLISSLSHRNRKEEKETDGKAGEW

SEQ ID NO: 29843 - protein, 27 aa, artificial
  peptide fold or domain or sub-domain
MNDVKFRKYVTALCPRSVKQKEHPPFL

SEQ ID NO: 29844 - protein, 29 aa, artificial
  peptide fold or domain or sub-domain
KECLVTSSGIDNTENGLSGSKAATKPTPK

SEQ ID NO: 29845 - protein, 26 aa, artificial
  peptide fold or domain or sub-domain
MSILDGGGHAQKHNEPVSPVGLDWPW

SEQ ID NO: 29846 - protein, 26 aa, artificial
  peptide fold or domain or sub-domain
AEEPSRGQPCVACGEQCPGFSLHKWR

SEQ ID NO: 29847 - protein, 28 aa, artificial
  peptide fold or domain or sub-domain
MIAELVSSAAAAVLYLNTLDADFCYDDR

SEQ ID NO: 29848 - protein, 24 aa, artificial
  peptide fold or domain or sub-domain
MAVIIIKIHGSDITMEQTNEHSRR

SEQ ID NO: 29849 - protein, 29 aa, artificial
  peptide fold or domain or sub-domain
MDDPSLSTDIGTPAQSDRWDHIHHPDKRK

SEQ ID NO: 29850 - protein, 28 aa, artificial
  peptide fold or domain or sub-domain
MASIVSVKTEKRPAADSQDADSNAKKPR

SEQ ID NO: 29851 - protein, 29 aa, artificial
  peptide fold or domain or sub-domain
SKYKSMSYKRIRKGNTKQKIDEFESRMNL

SEQ ID NO: 29852 - protein, 29 aa, artificial
  peptide fold or domain or sub-domain
MRFDPHVIIIMSSAFFQPQLCLQLPFRHR

SEQ ID NO: 29853 - protein, 30 aa, artificial
  peptide fold or domain or sub-domain
MNVVKILMLGRNVHARTPVLVSSLTSCHRP

SEQ ID NO: 29854 - protein, 30 aa, artificial
  peptide fold or domain or sub-domain
MVEHLFLDGTLPLQSARTPAAEASYPLMRN

SEQ ID NO: 29855 - protein, 30 aa, artificial
  peptide fold or domain or sub-domain
MGEEVSEVPKELVGKNRRGPFAAMCPPWSQ

SEQ ID NO: 29856 - protein, 26 aa, artificial
  peptide fold or domain or sub-domain
MADREKRKPSPPSGRNVRVNSPASFR

SEQ ID NO: 29857 - protein, 29 aa, artificial
  peptide fold or domain or sub-domain
MTYHRVTIQRKWLLVNPSESKFPVVSMPV

SEQ ID NO: 29858 - protein, 26 aa, artificial
  peptide fold or domain or sub-domain
MKSWCAVLLGLHLVRGACMSLIEGSP

SEQ ID NO: 29859 - protein, 30 aa, artificial
  peptide fold or domain or sub-domain
MDACPAPLFVIAFFPASSCVCMYANDGLIS

SEQ ID NO: 29860 - protein, 27 aa, artificial
  peptide fold or domain or sub-domain
MQSFLEVPLSPWTCRRPLIFTGRRSWL

SEQ ID NO: 29861 - protein, 30 aa, artificial
  peptide fold or domain or sub-domain
MTLHGDNFTGLSSGVAFTDQLATTTSVVHV

SEQ ID NO: 29862 - protein, 29 aa, artificial
  peptide fold or domain or sub-domain
MGETKIGDASFHMTSGDVMKMDGQPRRSA

SEQ ID NO: 29863 - protein, 24 aa, artificial
  peptide fold or domain or sub-domain
ETRVLRVKVIAGIDLAKKDIIGAR

SEQ ID NO: 29864 - protein, 27 aa, artificial
  peptide fold or domain or sub-domain
MSGKIESKQGKSCPAGSDHTAAPRDTA

SEQ ID NO: 29865 - protein, 24 aa, artificial
  peptide fold or domain or sub-domain
MKLCNRNVLTEVILRRDQMKHKGA

SEQ ID NO: 29866 - protein, 27 aa, artificial
  peptide fold or domain or sub-domain
MMGEVKGRQARTLHAKQDVVGVCRSRV

SEQ ID NO: 29867 - protein, 30 aa, artificial
  peptide fold or domain or sub-domain
MASEGCFEASGQVIKPSLSGARAGDAETLW

SEQ ID NO: 29868 - protein, 29 aa, artificial
  peptide fold or domain or sub-domain
MLQGHHHGLLDQVPLDEAAEVLAVNGEVG

SEQ ID NO: 29869 - protein, 28 aa, artificial
  peptide fold or domain or sub-domain
MLVISSRSAMLSVYYPQIFLILTSGSYL

SEQ ID NO: 29870 - protein, 27 aa, artificial
  peptide fold or domain or sub-domain
MTSGVTHRAGGSCLRRRIVVLGGMSPS

SEQ ID NO: 29871 - protein, 28 aa, artificial
  peptide fold or domain or sub-domain
MGWISLICAQVHLVCTCVLARRSVPQTN

SEQ ID NO: 29872 - protein, 26 aa, artificial
  peptide fold or domain or sub-domain
IEELKNENALLRAQLQQHGIEVVGET

SEQ ID NO: 29873 - protein, 28 aa, artificial
  peptide fold or domain or sub-domain
MANLLRDIQELGSHAVDIYDYLLAGVGE

SEQ ID NO: 29874 - protein, 27 aa, artificial
  peptide fold or domain or sub-domain
RSPPNMSSHAKVKKDKEIIAEYETQVK

SEQ ID NO: 29875 - protein, 29 aa, artificial
  peptide fold or domain or sub-domain
MEPIRARFRLFPLCLAIRLPLRCFVVFRI

SEQ ID NO: 29876 - protein, 25 aa, artificial
  peptide fold or domain or sub-domain
MVDILMLMFFAIMGLVFLSYIIYML

SEQ ID NO: 29877 - protein, 25 aa, artificial
  peptide fold or domain or sub-domain
RLGSKASKYANKLSLAINMKTLDDY

SEQ ID NO: 29878 - protein, 28 aa, artificial
  peptide fold or domain or sub-domain
MLNQSAVMIFTGICGALVLMAMAYYVYW

SEQ ID NO: 29879 - protein, 27 aa, artificial
  peptide fold or domain or sub-domain
AAQSKTKPQGLRQTKACPLTPTGPVVD

SEQ ID NO: 29880 - protein, 30 aa, artificial
  peptide fold or domain or sub-domain
MLLLTRRRHPSSSKGPLAPSKARLPNQARR

SEQ ID NO: 29881 - protein, 26 aa, artificial
  peptide fold or domain or sub-domain
MGFINKQRLEEGLVLDRDRDRDRPWP

SEQ ID NO: 29882 - protein, 28 aa, artificial
  peptide fold or domain or sub-domain
MAEGGFDPCECVCSHEYAMRRLLNLVRH

SEQ ID NO: 29883 - protein, 29 aa, artificial
  peptide fold or domain or sub-domain
RDCFKEYFIHKFRAMLGKNRIIFPGEKVN

SEQ ID NO: 29884 - protein, 25 aa, artificial
  peptide fold or domain or sub-domain
MFNKTSSERLPLLSEESNSYATAER

SEQ ID NO: 29885 - protein, 26 aa, artificial
  peptide fold or domain or sub-domain
KEQKEEIREINRPEGISVALFIPGFI

SEQ ID NO: 29886 - protein, 29 aa, artificial
  peptide fold or domain or sub-domain
PTMTERCSLWSALSAAACCFYRGSFMQVQ

SEQ ID NO: 29887 - protein, 26 aa, artificial
  peptide fold or domain or sub-domain
MIQRALYVLVGITMTGVLYFLIRAVR

SEQ ID NO: 29888 - protein, 26 aa, artificial
  peptide fold or domain or sub-domain
SFEGHPGAQWVDVMSANEPIDNLSIG

SEQ ID NO: 29889 - protein, 26 aa, artificial
  peptide fold or domain or sub-domain
VGDLRELPSHHPRAASNFPKHVSFDG

SEQ ID NO: 29890 - protein, 28 aa, artificial
  peptide fold or domain or sub-domain
GDFCTGYDLTKLANHTAFIKLEQDVILL

SEQ ID NO: 29891 - protein, 28 aa, artificial
  peptide fold or domain or sub-domain
SGTERHELTSWMSFNSIFRFFSEVLELK

SEQ ID NO: 29892 - protein, 29 aa, artificial
  peptide fold or domain or sub-domain
MMFIQEYRWIEQFKEGRHDQVSSQVKGCY

SEQ ID NO: 29893 - protein, 29 aa, artificial
  peptide fold or domain or sub-domain
WSLSGCDSTGFRANATLVSAAGGPNQWSS

SEQ ID NO: 29894 - protein, 24 aa, artificial
  peptide fold or domain or sub-domain
YMQMSYLSFLLRESASQAGESEIR

SEQ ID NO: 29895 - protein, 29 aa, artificial
  peptide fold or domain or sub-domain
FVTATQMAVVNKGLGGELGVITVLYCQEL

SEQ ID NO: 29896 - protein, 30 aa, artificial
  peptide fold or domain or sub-domain
MGWKITMLILSSLALVLGTVILILNVYSNR

SEQ ID NO: 29897 - protein, 29 aa, artificial
  peptide fold or domain or sub-domain
SLPLSNQSEHQCPVGCYEVQMFDHHRSTS

SEQ ID NO: 29898 - protein, 25 aa, artificial
  peptide fold or domain or sub-domain
VHSVSELLDLYEEDPEEILLNLGFG

SEQ ID NO: 29899 - protein, 30 aa, artificial
  peptide fold or domain or sub-domain
MAPKKKPVPLNIAPIGEGQASSNTIDVASE

SEQ ID NO: 29900 - protein, 30 aa, artificial
  peptide fold or domain or sub-domain
PAEASEGIVGALMMVMQKRSKVIHSSGKFS

SEQ ID NO: 29901 - protein, 28 aa, artificial
  peptide fold or domain or sub-domain
MPGEQPVAPGRVVLVKRFVMRDGAAVGT

SEQ ID NO: 29902 - protein, 28 aa, artificial
  peptide fold or domain or sub-domain
MKEESGGRSVEEAAYGCRKSTAGGSISI

SEQ ID NO: 29903 - protein, 24 aa, artificial
  peptide fold or domain or sub-domain
MQKVSEICVLLFQWLARRVNEISE

SEQ ID NO: 29904 - protein, 25 aa, artificial
  peptide fold or domain or sub-domain
MIRFPPRLKAVINKRLLEPQALWRL

SEQ ID NO: 29905 - protein, 25 aa, artificial
  peptide fold or domain or sub-domain
RREKNRAAAQRSRKKQTQRADVLHQ

SEQ ID NO: 29906 - protein, 29 aa, artificial
  peptide fold or domain or sub-domain
LLTCVPRTVEEIEAFMAEPAKAFGPVDGT

SEQ ID NO: 29907 - protein, 27 aa, artificial
  peptide fold or domain or sub-domain
MVEKTRHRGSQCFHRPHLEEPRWNPQF

SEQ ID NO: 29908 - protein, 24 aa, artificial
  peptide fold or domain or sub-domain
SQCWANGLAGLIMSERNYTGPRET

SEQ ID NO: 29909 - protein, 29 aa, artificial
  peptide fold or domain or sub-domain
MTIQNWPSVVAVGSPDQGKCRVACYPLGE

SEQ ID NO: 29910 - protein, 28 aa, artificial
  peptide fold or domain or sub-domain
AYPAAYAPISQAFPQQPTIIPQQQREGK

SEQ ID NO: 29911 - protein, 26 aa, artificial
  peptide fold or domain or sub-domain
MDSSNNCTSPHEERFLNQYCKYIRVI

SEQ ID NO: 29912 - protein, 15 aa, artificial
  peptide fold or domain or sub-domain
SPNYWGGGSMVTVTC

SEQ ID NO: 29913 - protein, 17 aa, artificial
  peptide fold or domain or sub-domain
WWIIKGPITASLFVSYN

SEQ ID NO: 29914 - protein, 27 aa, artificial
  peptide fold or domain or sub-domain
KLLPSHRTLCLWHTSMPITLSGVPPAI

SEQ ID NO: 29915 - protein, 25 aa, artificial
  peptide fold or domain or sub-domain
CEHMMDTEGILEVQAKKKANLQYYA

SEQ ID NO: 29916 - protein, 19 aa, artificial
  peptide fold or domain or sub-domain
MQTEIRAVYYCARKKYHSD

SEQ ID NO: 29917 - protein, 19 aa, artificial
  peptide fold or domain or sub-domain
RRKRDKQQDSSTDNSLDCS

SEQ ID NO: 29918 - protein, 26 aa, artificial
  peptide fold or domain or sub-domain
MFVKREIRVQSNAEVLHSSIASLSSI

SEQ ID NO: 29919 - protein, 17 aa, artificial
  peptide fold or domain or sub-domain
YYSWDYRGQGNQVIVTA

SEQ ID NO: 29920 - protein, 29 aa, artificial
  peptide fold or domain or sub-domain
MSAMASLRACSDTASDLEKSCTFHTCQQP

SEQ ID NO: 29921 - protein, 11 aa, artificial
  peptide fold or domain or sub-domain
DLYRTFVKDYP

SEQ ID NO: 29922 - protein, 15 aa, artificial
  peptide fold or domain or sub-domain
RQLADLYRSFVKDYP

SEQ ID NO: 29923 - protein, 27 aa, artificial
  peptide fold or domain or sub-domain
MPAANVTIRHYLLAIGVFCSPAKSAGL

SEQ ID NO: 29924 - protein, 15 aa, artificial
  peptide fold or domain or sub-domain
DPEPQYMVLVPFLFH

SEQ ID NO: 29925 - protein, 20 aa, artificial
  peptide fold or domain or sub-domain
YVDLHVCDKSINTYYPPVQK

SEQ ID NO: 29926 - protein, 13 aa, artificial
  peptide fold or domain or sub-domain
DDATSDAATGPSG

SEQ ID NO: 29927 - protein, 29 aa, artificial
  peptide fold or domain or sub-domain
SRRLLRELKVQRRRHLAASTISAYWKGYQ

SEQ ID NO: 29928 - protein, 12 aa, artificial
  peptide fold or domain or sub-domain
ZTPLYPKVYTMD

SEQ ID NO: 29929 - protein, 17 aa, artificial
  peptide fold or domain or sub-domain
HAEGTYTSDVSSLBBYF

SEQ ID NO: 29930 - protein, 17 aa, artificial
  peptide fold or domain or sub-domain
MQKIVVYVYIYLFMQIA

SEQ ID NO: 29931 - protein, 30 aa, artificial
  peptide fold or domain or sub-domain
MGICRPAGEISNSLQMPKLILLLVMCVIFW

SEQ ID NO: 29932 - protein, 22 aa, artificial
  peptide fold or domain or sub-domain
IISNKENLYIEEYSVSQTTLDQ

SEQ ID NO: 29933 - protein, 11 aa, artificial
  peptide fold or domain or sub-domain
MSNINRWLLST

SEQ ID NO: 29934 - protein, 25 aa, artificial
  peptide fold or domain or sub-domain
MFLCAAGLSHLEVYEPSYYEWTWFV

SEQ ID NO: 29935 - protein, 27 aa, artificial
  peptide fold or domain or sub-domain
WLRLDDIICPHRRHLYFTAILHQPSRD

SEQ ID NO: 29936 - protein, 26 aa, artificial
  peptide fold or domain or sub-domain
MSAVLCQFVAVPYHRCFPCSCLFNPA

SEQ ID NO: 29937 - protein, 24 aa, artificial
  peptide fold or domain or sub-domain
FFLTVVLTESNNLFARRPFFSYYR

SEQ ID NO: 29938 - protein, 21 aa, artificial
  peptide fold or domain or sub-domain
MGSGHVLVAGAVLVALVALGA

SEQ ID NO: 29939 - protein, 25 aa, artificial
  peptide fold or domain or sub-domain
DDEKKPQEKGIENKSENKEKDQEIV

SEQ ID NO: 29940 - protein, 20 aa, artificial
  peptide fold or domain or sub-domain
EVPCDNIYKRICQMDAIRLD

SEQ ID NO: 29941 - protein, 11 aa, artificial
  peptide fold or domain or sub-domain
MSNMTRWLLST

SEQ ID NO: 29942 - protein, 15 aa, artificial
  peptide fold or domain or sub-domain
VTRSHLANEIPDEKA

SEQ ID NO: 29943 - protein, 29 aa, artificial
  peptide fold or domain or sub-domain
DFWRMLWENNSTIVVMLTKLREMGRVSVL

SEQ ID NO: 29944 - protein, 29 aa, artificial
  peptide fold or domain or sub-domain
GGGCVGGVHRADPTGAGQDLLTQRPLRSQ

SEQ ID NO: 29945 - protein, 21 aa, artificial
  peptide fold or domain or sub-domain
MLFSGVGIAKFLIQQIMPTPS

SEQ ID NO: 29946 - protein, 30 aa, artificial
  peptide fold or domain or sub-domain
MGQSDGGRSRGPGRQLSVKEKMGFCVNVGV

SEQ ID NO: 29947 - protein, 25 aa, artificial
  peptide fold or domain or sub-domain
MGATKSKPREGGPRSLSLDIVEGSH

SEQ ID NO: 29948 - protein, 18 aa, artificial
  peptide fold or domain or sub-domain
PLAGIIEDKILLKENNNQ

SEQ ID NO: 29949 - protein, 11 aa, artificial
  peptide fold or domain or sub-domain
MTITRWSFQLI

SEQ ID NO: 29950 - protein, 15 aa, artificial
  peptide fold or domain or sub-domain
PNRRLHGPSGHPTKT

SEQ ID NO: 29951 - protein, 30 aa, artificial
  peptide fold or domain or sub-domain
KTSYAKPLQLLKGVGTKCWAPDTEYALHSV

SEQ ID NO: 29952 - protein, 19 aa, artificial
  peptide fold or domain or sub-domain
MILVWEKDQQPTCQKRGRV

SEQ ID NO: 29953 - protein, 20 aa, artificial
  peptide fold or domain or sub-domain
MVNDHLDQLQAFSCVVCHNS

SEQ ID NO: 29954 - protein, 17 aa, artificial
  peptide fold or domain or sub-domain
MSSSFESELGQRDCKDL

SEQ ID NO: 29955 - protein, 26 aa, artificial
  peptide fold or domain or sub-domain
YVRAWVAWRLHCQNQDLRSYVAGCGV

SEQ ID NO: 29956 - protein, 19 aa, artificial
  peptide fold or domain or sub-domain
AREIWGMEPTLEKLPTPDM

SEQ ID NO: 29957 - protein, 11 aa, artificial
  peptide fold or domain or sub-domain
MSFFTRWLLST

SEQ ID NO: 29958 - protein, 11 aa, artificial
  peptide fold or domain or sub-domain
MSFITRWLLST

SEQ ID NO: 29959 - protein, 29 aa, artificial
  peptide fold or domain or sub-domain
QFLPITLAACLLYTMLLLSTSSIPPNNYT

SEQ ID NO: 29960 - protein, 11 aa, artificial
  peptide fold or domain or sub-domain
MSTINRWLLST

SEQ ID NO: 29961 - protein, 29 aa, artificial
  peptide fold or domain or sub-domain
MASCAVQLVSNSVQNVTKLSFNHIHTSVF

SEQ ID NO: 29962 - protein, 19 aa, artificial
  peptide fold or domain or sub-domain
PKRKQGAAGDDKEEPQRRR

SEQ ID NO: 29963 - protein, 25 aa, artificial
  peptide fold or domain or sub-domain
NKADPVSVRLGAKNPPCEGAVEIKS

SEQ ID NO: 29964 - protein, 20 aa, artificial
  peptide fold or domain or sub-domain
PAETPNSLDLTFNRRIMDTI

SEQ ID NO: 29965 - protein, 24 aa, artificial
  peptide fold or domain or sub-domain
ASGPTQAGIVGRKRQKGEMFVGLM

SEQ ID NO: 29966 - protein, 20 aa, artificial
  peptide fold or domain or sub-domain
VIGGTEAQPNSWPWQVSLQY

SEQ ID NO: 29967 - protein, 25 aa, artificial
  peptide fold or domain or sub-domain
ERPMRRSLVFPMETDNSYVELVPQK

SEQ ID NO: 29968 - protein, 20 aa, artificial
  peptide fold or domain or sub-domain
TPELWKKLILTHHWPVTVCK

SEQ ID NO: 29969 - protein, 24 aa, artificial
  peptide fold or domain or sub-domain
DGGEDRDAAVEEAVLGTGGCRTPK

SEQ ID NO: 29970 - protein, 23 aa, artificial
  peptide fold or domain or sub-domain
SVDNQEGRERKAGKNFYWKGPTS

SEQ ID NO: 29971 - protein, 22 aa, artificial
  peptide fold or domain or sub-domain
MGPEEVMVQASSPGLISATEVL

SEQ ID NO: 29972 - protein, 15 aa, artificial
  peptide fold or domain or sub-domain
YPNTELSNMGCEECT

SEQ ID NO: 29973 - protein, 20 aa, artificial
  peptide fold or domain or sub-domain
EKSQTPLVRLFKNALLKNAY

SEQ ID NO: 29974 - protein, 23 aa, artificial
  peptide fold or domain or sub-domain
IKWTAPDTSSKSIRLYDVWTFGV

SEQ ID NO: 29975 - protein, 26 aa, artificial
  peptide fold or domain or sub-domain
NDETTLLVTGFSIKEVNGTDVWAFGV

SEQ ID NO: 29976 - protein, 26 aa, artificial
  peptide fold or domain or sub-domain
IKWMALDTLYVFVVARVYLDVWTFGV

SEQ ID NO: 29977 - protein, 25 aa, artificial
  peptide fold or domain or sub-domain
LKWMAPETIFDRDITSQSDVWAFGV

SEQ ID NO: 29978 - protein, 20 aa, artificial
  peptide fold or domain or sub-domain
NAVTKSHLSNEIPAEKALQS

SEQ ID NO: 29979 - protein, 28 aa, artificial
  peptide fold or domain or sub-domain
MTYFVIFLGICFMLGVLAGRLILRRIMG

SEQ ID NO: 29980 - protein, 21 aa, artificial
  peptide fold or domain or sub-domain
MPGATTHRFFSHLTFEFSTLV

SEQ ID NO: 29981 - protein, 22 aa, artificial
  peptide fold or domain or sub-domain
VIWYLKTSQHSFADLWELMWKT

SEQ ID NO: 29982 - protein, 28 aa, artificial
  peptide fold or domain or sub-domain
YLTGDQFSSESSLEAYARCLRMGCRCIE

SEQ ID NO: 29983 - protein, 11 aa, artificial
  peptide fold or domain or sub-domain
GFMMYIVNRCD

SEQ ID NO: 29984 - protein, 12 aa, artificial
  peptide fold or domain or sub-domain
MDSKCIGIVAVT

SEQ ID NO: 29985 - protein, 11 aa, artificial
  peptide fold or domain or sub-domain
GFKMYVVKRCD

SEQ ID NO: 29986 - protein, 27 aa, artificial
  peptide fold or domain or sub-domain
CFKKDAHKMETFLKLLKCRQADKFNCA

SEQ ID NO: 29987 - protein, 26 aa, artificial
  peptide fold or domain or sub-domain
MSGSGPAMASLEPGLAGSLNRGQTDA

SEQ ID NO: 29988 - protein, 18 aa, artificial
  peptide fold or domain or sub-domain
GFMNYRLSRCDFNSNELK

SEQ ID NO: 29989 - protein, 25 aa, artificial
  peptide fold or domain or sub-domain
PLSLTIILTIVLLPVTPSIIPIWLQ

SEQ ID NO: 29990 - protein, 29 aa, artificial
  peptide fold or domain or sub-domain
FGLSDGNWHHVAVSVSAKHLALHVDCTRL

SEQ ID NO: 29991 - protein, 28 aa, artificial
  peptide fold or domain or sub-domain
MEFLPGGAALLQLLLSIGRCCSTDPDRK

SEQ ID NO: 29992 - protein, 20 aa, artificial
  peptide fold or domain or sub-domain
GFKMYVVSRCDFNSSELKAH

SEQ ID NO: 29993 - protein, 29 aa, artificial
  peptide fold or domain or sub-domain
EENCPPHAAPLCGCGEGDDGQTAAEARRD

SEQ ID NO: 29994 - protein, 16 aa, artificial
  peptide fold or domain or sub-domain
LGGEIALCRWSSWPLN

SEQ ID NO: 29995 - protein, 12 aa, artificial
  peptide fold or domain or sub-domain
VGSKCFGCITVT

SEQ ID NO: 29996 - protein, 11 aa, artificial
  peptide fold or domain or sub-domain
WIHELYGGSLC

SEQ ID NO: 29997 - protein, 11 aa, artificial
  peptide fold or domain or sub-domain
MDFWSILWVAV

SEQ ID NO: 29998 - protein, 11 aa, artificial
  peptide fold or domain or sub-domain
MDFWSMLWIAV

SEQ ID NO: 29999 - protein, 11 aa, artificial
  peptide fold or domain or sub-domain
MDSWSIVCGAV

SEQ ID NO: 30000 - protein, 29 aa, artificial
  peptide fold or domain or sub-domain
FPGDFTPEIHVSIDKFLQNVALALSEKYR

SEQ ID NO: 30001 - protein, 9 aa, artificial
  peptide tag
YPYDVPDYA

SEQ ID NO: 30002 - protein, 14 aa, artificial
  peptide tag
GKPIPNPLLGLDST

SEQ ID NO: 30003 - protein, 6 aa, artificial
  peptide tag
HHHHHH

SEQ ID NO: 30004 - protein, 10 aa, artificial
  peptide tag
FQKLISEEDL

SEQ ID NO: 30005 - protein, 9 aa, artificial
  peptide tag
DYKDDDDKC

SEQ ID NO: 30006 - protein, 3 aa, artificial
  linker sequence
GTG

SEQ ID NO: 30007 - protein, 8 aa, artificial
  linker sequence
GGGTGGGS

SEQ ID NO: 30008 - protein, 9 aa, artificial
  linker sequence
GGGSGGGTG

SEQ ID NO: 30009 - protein, 11 aa, artificial
  linker sequence
GGGTGGGSGGG

SEQ ID NO: 30010 - protein, 13 aa, artificial
  linker sequence
GGGTGGGSGGGSG

SEQ ID NO: 30011 - protein, 15 aa, artificial
  linker sequence
GGGSGGGTGGGSGGG

SEQ ID NO: 30012 - protein, 17 aa, artificial
  linker sequence
GGGTGGGSGGGSGGGSG

SEQ ID NO: 30013 - protein, 20 aa, artificial
  linker sequence
GGGSGGGSGGGSGGGSGGGG

SEQ ID NO: 30014 - protein, 25 aa, artificial
  linker sequence
GGGSGGGTGGGSGGGSGGGSGGGTG

SEQ ID NO: 30015 - protein, 27 aa, artificial
  linker sequence
GGGTGGGSGGGSGGGSGGGTGGGSGGG

SEQ ID NO: 30016 - protein, 31 aa, artificial
  linker sequence
GGGSGGGTGGGSGGGSGGGSGGGTGGGSGGG

SEQ ID NO: 30017 - protein, 46 aa, artificial
  linker sequence
GGGSGGGTGGGSGGGSGGGSGGGTGGGSGGGSGGGSGGGTGGGSGG

SEQ ID NO: 30018 - protein, 59 aa, artificial
  linker sequence
GGGTGGGSGGGSGGGSGGGTGGGSGGGSGGGSGGGTGGGSGGGSGGGSGGGTGGGSGGG

SEQ ID NO: 30019 - protein, 19 aa, artificial
  linker sequence
GTAGAGGAGGGGAGGAGAG

SEQ ID NO: 30020 - protein, 19 aa, artificial
  linker sequence
GTAGGAGAGGGAGAAGGGG

SEQ ID NO: 30021 - protein, 19 aa, artificial
  linker sequence
GTAAGGAGAGGGGAGGAGG

SEQ ID NO: 30022 - protein, 19 aa, artificial
  linker sequence
GTAGGAAGAGGAGAGAAGG

SEQ ID NO: 30023 - protein, 19 aa, artificial
  linker sequence
GTAAGAGGAGGGAGGAAAG

SEQ ID NO: 30024 - protein, 19 aa, artificial
  linker sequence
GTAGAGGGAGGAAAAGAAG

SEQ ID NO: 30025 - protein, 19 aa, artificial
  linker sequence
GTAGAAGAGAAGAAGGAGG

SEQ ID NO: 30026 - protein, 19 aa, artificial
  linker sequence
GTAAGAGGAAAGAGAAGAG

SEQ ID NO: 30027 - protein, 19 aa, artificial
  linker sequence
GTAAAGAGAAGGAAAGAAG

SEQ ID NO: 30028 - protein, 19 aa, artificial
  linker sequence
GTSGGGGSGGGSGGSGGGG

SEQ ID NO: 30029 - protein, 19 aa, artificial
  linker sequence
GTSSGGSGGGGSGSGGGGG

SEQ ID NO: 30030 - protein, 19 aa, artificial
  linker sequence
GTSGGGGSGGSGSGSGGGG

SEQ ID NO: 30031 - protein, 19 aa, artificial
  linker sequence
GTSGSSGSGSGGSGSGGGG

SEQ ID NO: 30032 - protein, 17 aa, artificial
  protein transduction domain sequence
CRQIKIWFQNRRMKWKK

SEQ ID NO: 30033 - protein, 10 aa, artificial
  protein transduction domain sequence
GRKKRRQRRR

SEQ ID NO: 30034 - protein, 11 aa, artificial
  protein transduction domain sequence
GRKKRRQRRRP

SEQ ID NO: 30035 - protein, 12 aa, artificial
  protein transduction domain sequence
GRKKRRQRRRPP

SEQ ID NO: 30036 - protein, 13 aa, artificial
  protein transduction domain sequence
GRKKRRQRRRPPQ

SEQ ID NO: 30037 - protein, 11 aa, artificial
  protein transduction domain sequence
GRKKRRQRRRG

SEQ ID NO: 30038 - protein, 12 aa, artificial
  protein transduction domain sequence
GRKKRRQRRRPG

SEQ ID NO: 30039 - protein, 13 aa, artificial
  protein transduction domain sequence
GRKKRRQRRRPPG

SEQ ID NO: 30040 - protein, 14 aa, artificial
  protein transduction domain sequence
GRKKRRQRRRPPQG

SEQ ID NO: 30041 - protein, 10 aa, artificial
  protein transduction domain sequence
RRRQRRKKRG

SEQ ID NO: 30042 - protein, 11 aa, artificial
  protein transduction domain sequence
PRRRQRRKKRG

SEQ ID NO: 30043 - protein, 12 aa, artificial
  protein transduction domain sequence
PPRRRQRRKKRG

SEQ ID NO: 30044 - protein, 13 aa, artificial
  protein transduction domain sequence
QPPRRRQRRKKRG

SEQ ID NO: 30045 - protein, 11 aa, artificial
  protein transduction domain sequence
GRRRQRRKKRG

SEQ ID NO: 30046 - protein, 12 aa, artificial
  protein transduction domain sequence
GPRRRQRRKKRG

SEQ ID NO: 30047 - protein, 13 aa, artificial
  protein transduction domain sequence
GPPRRRQRRKKRG

SEQ ID NO: 30048 - protein, 14 aa, artificial
  protein transduction domain sequence
GQPPRRRQRRKKRG

SEQ ID NO: 30049 - protein, 12 aa, artificial
  protein transduction domain sequence
AAVLLPVLLAAP

SEQ ID NO: 30050 - protein, 13 aa, artificial
  protein transduction domain sequence
GAAVLLPVLLAAP

SEQ ID NO: 30051 - protein, 12 aa, artificial
  protein transduction domain sequence
PAALLVPLLVAA

SEQ ID NO: 30052 - protein, 13 aa, artificial
  protein transduction domain sequence
PAALLVPLLVAAG

SEQ ID NO: 30053 - protein, 27 aa, ARTIFICIAL
  protein transduction domain sequence
GALFLGWLGAAGSTMGAWSQPKKKRKV

SEQ ID NO: 30054 - protein, 16 aa, ARTIFICIAL
  protein transduction domain sequence
AAVALLPAVLLALLAP

SEQ ID NO: 30055 - protein, 26 aa, ARTIFICIAL
  protein transduction domain sequence
GWTLNSAGYLLKINLKALAALAKKIL

SEQ ID NO: 30056 - protein, 18 aa, ARTIFICIAL
  protein transduction domain sequence
KLALKLALKALKAALKLA

SEQ ID NO: 30057 - protein, 9 aa, ARTIFICIAL
  protein transduction domain sequence
RRRRRRRRR
